United States Patent 9,567,581 (SELECTIVE REACTIVATION OF GENES ON THE INACTIVE X CHROMOSOME) - sequence listing, part 31

SEQ ID NO: 3650 - DNA, 66967 bp, human
gagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccctcggggcccgaggggcggccggagggctgagggcggtgagggtcacggctgaaaggccccggaggtcaacgccgggcggagggccgaagctggggtgggtgctgggggctgccctcgcgaggccccgcgctcggcggctgcggcttcccgcgcgggatctctggggcccggtactggggccggttcgaggtgggacccgggagctgcggggttttcccgaactccgggtgcggcggaggtggcggcagcgaagtaagagggctgcgacttgtagtgggaagagcccaggaggctggcgtccaggcgtgcgggggcggggggcccgaaacatgcccacggcgtcagagggccgtgggtcagcgcccggaatgtcgcctgtgagcccgggaggaaatgaggcgccagagccggcggggaccacgaccgaagtccaggcgagctgagaacgcgccggggctctttgcccgaggccgcgccaatcctcactgtctaagggtggctcttgcgagtggaagttgaagggaacctctaaacatctcagtccttgttgaaaaaggacgtgacgctcatgacctcctctggcgtcgaagaaatcctttgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtcaataattattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctgatatttaccacctgtgggactctgggctggtcatttcctctcttttgtgctgcagttagttttctcatctgtgaaatgaggaggttgaactgcataaattctaagagctcctccagctctaatcctcagagtgtttataaaagtgattagattactagcttagtttaacctgtcccactcaatggcccacattgtggcatgtcttaattataactagcatgtatatagcatttatgcccagcagttttctagctgctttacttgtactatttcatttaatctttaccaataatataacttgtaggtgctgttattagtcccattttgtacacgaaaaagttgaggcacagtgcgaccaagacccttgcccaaattcgcatacctggcaaagtggaagagctaggtttccaaccctggcagcctgattccagaggccatgcccttaaccactgtactcattgcttctgcccagcagaaaagacgagagtccttagctggacacctcccagggtagcagggcaggacggcttgggacccacgaaagtatgtgcaagccatttgttaagaagctaatgatactatattaggccgggtgcagtggctcatgcctgtaatcccagcactttaggagactgaggcagatggatcacttgaggccaggagtttgagcctggccaacatggcaaaaccccgtctactaaaaatacaaaaattagccgagtgtgggattacatgcctgtaatcccagctactcaggaagctgaggcatgagactcatttgatcctgggaggcagaggttgcagtgagggaagatcaggccactgcacttcagcctgggcgacagagcaagactgtctcaaaacaaaaaaagaagcgaatgatactacattggagactggctttatagtggctgggctgtgtggtccaaacaactagtactataggcattcaaaagagaaaaagctgacggttggtagtgttatggaagaggtaaaacttgagctagatcttctggatgactgggatttgagtaggtggagaatttattccaggtgggggcaatagcaggagcagagacccagaaatgagggcaagagtgctcctttgtggtcaagaaggaacctggcttggcaggagagtgcattggtaaagtcaatccaggcagaatagcttgatttgcccttgaaagctctgagtccggcacagcatgggaaaaataacacagaaggaggaagcaagcagggagacttcactgggtaggggagcccctggagtgtgaagctacataagaatctatggttgcaggtctccactagaaaaatgtgctgcgaacccttcctgtccaggaccatgacttactggtatcttcccacctggtggggcacaacagagcatatttgcatgattggggtaactaagaaagatgttggaagaaaaaaacgaacaggagttgatgcctgagtggatgtaagggaagggacagatgactcatatatgactcttgtgatttccttaacttttcccaaaatgtgcatgcctctgctagctgctgtgattggacaggcgagagcaaaagctataagctaagcaaaatgccttcttatgaaatagtagattgtgttaactcttaatttaaataggatgttgtgctagatgactgtacagacttgggatttgaggtttagatacagacatacttgggtcccttcctactcccttttctgaagtcagtggtgcaatccccaagacatggttgaaattaggtgcctaagggaagcttatcaggtagaagggatacttgttctgtctcaaaggccagggacacatatcaattcaacagaaaaccaaagcaaccctggccaggcacagtggttcacacctgtaatcccagcactttgggaggccgaggtgggtggatcacttgaggtcaggagttcgagaccagcctggccaacatggcgaaacccagtctctactaaaaatacaaaaattagccaggcgtggcagtgcacacctgtaatcccaactactcggaaggctgaggcaggagaatcgcttgaacccaggaggcagagtttgcagtgagctaagatcacaccagcgcactccagcctgggtaacagagcgagactccgtctccaaaaaaaaaaaaaaaaagcaactctttagaattgttttgtcttaaagaaataaagcagatagctaacacatagcacttgctgcctgtgggcactattctaagcacattgcttgtattaactcatttaatcctcataataaccctttgcaagaggttactattattatcctcatattagagatgagaaaactgagaaatagagaggttaagtaatttgcctgctggcaagtagtagaggtgggatataaactcaggcagtcaggctccagagtctgtgctcttaaacactacactatgttgaagttatacacgaagagctgttagagacctttacaagtagtataatcatcacttaatcatatatatgtctaggcatgttgtatacacacacagttcacatgtatttgtatatatttaaacatttggagattaaagtttcagtgcctgtgtttttttcaattttttattataaaatacacataaaatttaccatcttaatcatttttaagtacacagttcagtgttacgaaatacattcataatgctgtgcaaccatcatcaccatccatccccataactctttttatcttgtaaaactgaaactctgtacccattaaacaataactcctcattttcccctgcccctagcccctggcaaacaccattccactttctatctctatgattttgactactctaagtatctcatatgaatgtaatgatatactatttgtcttttttgtgactggcttatttctgttagcatagtgcccttatggttcatggtgtatcatatgtcagaatttttccttttttaaatttatatatatatatatatttattataccttaagttctagggtacattgcacaacgtgcaggtttgttacatatgtatacatgtgccatgttggtgtgctgcacccattaactcgtcatttacattaggtatatctcctaatgctatccctcccccatccccccaccccacaacaggccccggtgtgtgatgttccccttcctctgtccaagtgttctcaatgttcaattcccacctatgagtgagaacatgcagtgtttggtttttttgtccttgcgatagtttgctgaaaatgatggtttccagtttcatccatgtccctacaaaggagatgaactcatccttttttatgactgcatagtattccatggtgtatatgtgccacattttcttaatccagtctatcattgttggacatttgggttggttccaagtctttgctattgtgagtagtgctgcaataaacatacgtgtgcatgtgtctttatagcagcatgatttatactatttgtcttttttgtgactgacttatttctgttagcataatgccctcatggttcatgttgtatcatatgtcagaatttttcctttttaaaagctgactaatattccattgtatgcatataccatattttgcttatctgtttatctgtcaatggacacttaggttgcttccatgttttagcaatttcacaatactattatgaacctgggtgtagaatatctctttgagaccttgttttcacttcttttgggtatatacccagaaatggaattattgtatcatatgataattctatttgtaatttttttgaggaaccaccatactgttgtccatagtgaaattttaaatttccaccaactgtgcaccggggtttgaatttttccatatcattgccaacatttattttctgttttttgatagtagccattctaatgggagtgaggtgaaatctcattgtggttttggtttgcattttcctaaatattagtgatgatgaacaccttcatgtgcttattggctatttccttatctttgttggtgaaatatctatttaagcctttgcctatttctgaattgaatttttttttattgttgagttttaggcattctctgtatattctggatattaatcccttatcagatatatgatttacacatatttttccattctgtgagtcacttttttctgtgaatattttgatgcacacgttttaattttttccatgaaatccaattcgtcaattttttcttttgttacctacattgttggtgtcatatccaagaaattgttgctgaatccaatggtatgaagcttttgtcttatgttttcttctaaaaattttatagttttagtcttaaaatttcagtctctgatccattttgaattttttttttacttggtattgggtaagcgtccaatttcattctttttcatatggatatccagttttcccagcaccatttgttgaaaagattgtctgcattgagtggtcttggcactgttgtcaaaatcatttgaccatacatgtgatggtttatttctggactgtctattctattacattgatcagtatgtctgtctttatgccagtacacactgttttgattattgcagctttgtagtaagttcagaaatcaggaagtgtgagtcctacagctttgtttttccgtttcaagactgtttggctattcagggttccttgagatttcataagaattttaggatggatttttctatttctgcaaaactatgccattaagattttgataaggattgaattgaatctatatatcactttggatagtattgacatcttaacaatattaagtgttctaatacgtgaacatgggatgtgtttccatatcatctacaaacagagataattttacatcttattttaactggatgtcttttatctctttttcttgcctaattgctctgggtagaacttcaagtactatgttgaataggagtggtgaaagtgggcatctttgtttcattcctgaccctaaaggaaaagctttcagtctttcaccattaagggtgatgtttactgtgggtttttcatatataacttttaagtcaattttcttacactcctagtttgttgagtgtttttatcatgaaaagtaaattttgtctaatgctttttctgtatcaattgagatgatcaggtagttttttcccctttattctgttaatgtggtatattacattgatcaagttttgtatgttaaaacatctttgtattccaggaataaatcccacttggtcatggtctataatccttttgatatgcccgtgtattcactttactgctattttgttgagaatttgtacatcaatgttcataaggcatatgggtctgtagttttcttttcttgtagcgtctttgtctggctttggtatcaggtaatgctggcctcgtagaatgagttacgaagtttgagaaggtttggtactagttctttagatgtttggtagaattttatctgtgaagctatcaggtctagggcttttctttgttgagagatttttgattactgattcaatctccttactacttataggtctgtttagatttcctatttctttgtgatttagttttggtggttttgtgtttctggaaatgtgtccatttcatctaggctgtccaatttgttagtgtacggttgttcatagtactctcttataaccctttttatttctctagaatcagtagtgattctagagaaatactcattttcatttttgaaaatgagtaaagttctcattttcatttttgattttagtaatttcagtcttctttcttattagtccatctagctaaaggtttgtccgttttgttgatcttttcaagaagcttttagtttcattgattttctctatttttctattccctttttcttttatctctggtctaatcttcattatttccttccttatgatagcttaagattagtttgttctttttctagttacgcaagttgtaaagttaaggttgctgatttgagatctttcttgtttcttaatatgtgtttatagctataaatttttccaatagtactgctttcgctgcatcgtctacattttagatgtttatatttacgcctttcatcaaatttgggaagttgtcatccattatttctttattttctttttttgagacagagtctcactctgtcacccaggctggagtgcagtagcacgatctcagctcactgcaacctctgcctcccaggttcaagcgatgctcctgcctcagccacccaagtagctgggattacagatgtgcaccaccacactcagctaatttttgtatttttagtagaactggggtattgccatgttggctaggcttgtttcgaactcctggacccaggcaatctgcctgccttggcctcccaaagtgctgggatgagccaccacacccggctcattattttttcaagtattctttcttcctctttctctctcttctcctggaacccccataatgcatacactggtctgctgatggtgtaccacaggtctcttagactctgttcacttttcttcaatctttttttctttctgttcctcggactcaataatttttattgccctaatttcaagtttattgattctttcttctgcctgctcaaatctacctttgattctttttagtgaatttttcatttcagttgtgctttttctgctccagagtttctttttggtctctttttaggttttctatctctttattggtattttcattttgcttacatatcattttcttgactctctccacatcttcctttagttctgtgaacatctgaagatatttgtttcagaatctttctttaatatatttgccatcaggtctttttcagggacaggtttgctgttgtttaactttttttctttgggccatagtttcctggtttttttgttttgttttgttttgtctgtcttgtgattctttgttagaaactggacatttaaatctggtttctctggaaaccagattcccccttcccccaggatttgctgttttttgttattgttttgtttattgtctttatttttttgattattgtaggctgtctgtgtgttgagcatcaacctgaagtgtaaacttagtcttctcaggtttttttctgggctttccctgagcatgtgtggtcactttctgtttttctctgtatatatagttttgtttcattttgttttgttttgtttttgagacctagtctcgctctgttgcccaggctagagtgcagtggtgtgatcacagctcactgtaacctcgaatccctgggctcaagtgatcctcccacttcagtctcctgaggagctggaactacagattcatgccaccacacctagctaatttaaccaaacaaacaaaaaaaattgttttggtggagatgggatctcgcagtgttgccagggctgatctttaactgctggcctcaagtaatcctcctgcctcggcctaccgaagtgctgggattataggtgtgagtcaccatgcccagcctctgtagttgtttaagaatttctaatctttaatgcctggctcccaaaagtggaaaaggagaaaaatgaggcgacaagggaagagcgccattcttttacatcttctggaaatcactttagctagatagggagggcttgcaacagtggggataggtgcaaccacaatggctgccagcctctttgtctgtacctctgtgatcagaagcagcaatcagtaatcagaatacaaatccctgatatttggaggacagagtacttctgcccacatagcccacaagctgtgggcagagggctccaggaacatgtgcacagccgcctgccatggggttggggatgaaggatgggcagctactactatgtaaaagctgacattgattgaaatttatggcaatttgttgttcaagcctttcctgggaaattgcaagccttcaatgtaagtgtttcctgatataactctgcagtcttccaaaattgttacatcaaacagactctgccactaccattgttatctaggtgaggagatagatgtctggtgcttcctactcttgccttattcccagaatccatgtgtgtgtgtttttaaagtgtaggaagtagaaaaatcaaaagatatggaggaaaccagaagagaaaaagaaaaggatagcagatagccccaggaagcccaaaatgcaaaccagttagaagatctgaccaaaggacacttcaaaacagatgggagaatattaatcccatttgaaaggttgaatatagggcaggccattgttttatttcaaaactgaggttaaagtaggttttaaattaccttgaaaataaattggagtacaattgaaatgaaccacaaataggtatatttttattatcagggctttaatatttgtgtgggagtgggaggtaggtgggtagggagagtactggaagtgctaaactaggtttcttggatgtgtttctgggaactgcagaataaggcagataatcctacagtaaattgtagtctccagtaggaacaatgtttttattggaggctctctacctgacaaatgatttgtcttcaaaaatatcattgatatggtgttagaaaggccaaaatggaatagccatacatgcttttaatcacttaaaatcctaactttagcactgttgcctgagccattggtgctccctggtactagctcagttttaatgcagtgcaataggaattctttgtttccacaaggccttgtcctgctgtgggctgctccttcccacagttggaccttgggaaaaggtagagttagaagagggaatgattttttttatttcaaattttattatagattaaagggtatatgcacagatttgctacatgggtaaactgcatgacgctgagacttggggtccaacaatctgatcacccaggctgtaaccatggtacccaacaggtggttcttcggcccccaaacccacctccctccctcccttgtctagtgatccccagtgtctatcatttccatctttatgatcatgtgtattcagtgtttaacacccacttatgagtgagaacatgcggtatttggttttctattcttgcattagatcacttaggataaaggcctccagctccacccatgttgctgcaaagggcatggtttcattctttttatggctgcgtagtattccatggtatatatgtgccacattatctttatccagtccactgttggtgggcacttaggttagttccgtgtccttgcttttgtgaatagtgctgcagtgaacatacaggtgcatgtgtctttatgatagaatgagttattttcctttgggtatatatcaagtaatggaattgttgggttgaatggtagttctattttaagtccttttttttttttttttttttttttgagacatagtcttgctctgttgcccaggctggggtgcagtggtgcaatcttggctcactgcaacctccacctcctgggttcaagtgattcttatgccacagcctcctgagtttctggtattacagttgtacaccaccatgcctggctaatttttgtatttttagtagagacggtgtttcgttatgttgtccaggctggtcccgaactcatgatctcaagtgatccaaccgcctcagcctcccaaagtgctgggattataggcgtgaaccactgtgcctggcctattttaagttctttgagaaatctctaaagtgctttccacggtggtggaaccagtttgcatttccaccaacagggtataagcattccctattttccacagcctcatcaacatctgttttctgacttttaaataatcaccagggaatgaatgttgagggtcaagggcctttgtagactgctgaccaagtagctgctatgtataaaattgactgttagagaaacctcaactacagagtgtctgtgagtttgatgttttgatgttttgggacaaatggaattttttgctcagttagggaggaaggtaacagtataaatattgctgattatgtaacaggcccagtgcactccaaagtattagcatagagtacaagatttaactctatcatttggtaaattactattactataatccttaagtaattaataatggttccgttcatcactttagaaaatttgggggaattattttcaaataattttaataaacttctatgttgaaataatttttgatttacagaaaagttgcaaaggtgggacagagggttcctgtatacccatcacccagtttctgggggatgattttgatagtctcaggagaacttctcaggaaagtttaaaatgatgtttcacagttcctcctctttctcttccctcttcagattagtcaaagctctagctccagctgtttagtgtcagacctcaggggaacaagggctgctaagtctctttctcagtacttctttggaaaagctataaaaaaacaattaccaggtcatgttagcaagcagaattaaagatgagcttcttaaacttacttatagaactgctgagattttgaacaatctgattttttgttgttgtcattgtttttgagacagggtcttgctccgtcacccaggctagagtgcagtggcatgatcttggctcactgcagcggcatgatcttggctcactgcagcctcaaactcccgggctcaagtcatccttttgcttcagccccccagtacctgggactataggcatgtaccagcatgtttggctaacttttgtaacttttttgtatagatgggattttgctatgttgccggggctggtctcaaactcctgggctcaagccgcttggtctcccaaagtgccaggattacaggtgtgagccgccgtgcccagtctgaagagtctgtatggagtgaggtgtggatcccaaggttagggaaccccaaattcctggaagagaacaacttggaaatattagtatttaagaatatcactcttctctatggaagtggttaagaatgtgaccttggagccacacttttcaagtgacactcccagctctgccgtttactgtagccatgggatatggaacaaattacttcacctgcttgttgcttcagttgcctcatctttaacatgaggccaataggccaggtgtggtggctttatacctgtaatcccagaactttgggaggccaaggtgggcggatcacttgagctcaggagttcgagaccagcctggccagtgtggcaaaaacccatctctactaaaattacaaaaattagccaggcgtggtggcatgtgcctgtagtcccagtaacaggctaggtgaatcacttcaccccaggaggcagaggctgcagtgagctgagatcgtgccactgcactccagcctgggttacaaagtgagattctatctcaaaaaacaacaacaacaaaaacatgaggctaatactagtccctatctccaagattgttgtgaggattaaatggattaatatgtgtggaatatttagaatagtccctggcccagtaaatgttagatgttgttaactcagttattactgtcttgtcctctaggacttgggagaattaagcaaaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgtggtgtaaaagtaaacggccatatggaaagtgaaaaagtaagttgtcagtggcaggtgtgtttgagtagagggttctgtaatgcccgcggaaaaaggaggaagactttcaagatttctagtcaactgatataagtgaatttttgttaataggtttggataatttcaggtcctttatgataatcttattcaacttttttttcaaaatctttttataccttctttcggtgtgtatgtgtttgttgcagggtggcggcggtgagtgggttgggtgtttggggttgaatttgtccaggattttgagtaggcagaatgagaagttattagcaacagtgctttgcatcagtgaattgtagaagcaccaagttcaggcagctttggtggcaggaagtcaggagaactagcttctgattggcactgtcactcttagctgactctatggcctggaataaattgcttaacctctctgagcgtttgtttccttatgtataaagtatggctttactcacttcgctggcttgctgggacacagaaaataatgtatatatacaaaagtttaatagtcaggatggaacatgctcttcctctggagggaaatttgctaatctgccttcctctcccttgtcctgctgaggtgttacttatggtttaggcgttaattgataaagaattgaggcttatcagaagtatttgcattttaaaagaggtcttctaaatgtggaagccaatgatactactagcagtgagactggagtttgcctttacatactgtcggcttcctcttgttcctcctaaggaagggccttaggcatttggagtcttagtggtgatttttggtaattgagccttgagaaattcacagaaagaccctaagtgcctctggctgtaagccctgtaatcacccaagtgtctaactgaaaccctgagcagaggttgcttttcaggtcccttttccttaagttgtcaaggatcaatcaggtagccaggctggtgttctagcctagaaatggggctatttcctcagagtatgtgcagaaatctagagttaaatgtaactttaggagacagtagaatcagatagaattgtgcttgaaattttatctcttcccgtttcaagctgtttgattttgggcaaatcacttaacctctctgagctcccattttcttgtttataaaatatggggttgttttggcggggggcgggtaataatagtaccaactgaatatggatggtgtgtgcattaaaggagatgaggtttgtaatgcacctgacacagagttagtgctaggtaattgttagcttttattattgttactgttgttaggttgagccatgtgaaattaccacttttatgggtcaaaatggttgaatgttgtcagtattatttgtcagcctaatattatcatttaatcttgtttcctccattttacccctgaagaaaccagatagagaccaaaaagggtgacctctgcctaaggccagctcattcattgtagccatttgacagcattgatggccatcagtcctacatttgtgatgaacacggattattccttccagtcagtgataggagatatcctgtctggacctttttcaagtttatcatcaggaggctgaaaatgaatggcagaagtaattttcctctcctctttctgtcctttgggtacagcattagcatcattgggccaaactgaggtatccctgaagcatattgaagcaatggcattatgatagtttgtacattagggggcttaggaaaatgttcaaaggtcccaagttgctaaatgagataaacccttgaggtcattttcaatcttaagattggaggctcatcaagttgagagacagggatttgcagaggatttttggaaaagaaaagattagtgtaaatggcagccctccaccattttttaggcagtgtctaatagttcctcagctggcaagtagaaggaggatctagcatcagattttagatatctttcatcactaagagatgggcaagtcccattaggcaaactaatcaaaaggccaggcatccaaataggaagatgctgaagctaactccctttctttttgagaaaggaattctggagttgagaaaggtgcagtccagccaagtgaacattggtctggggagatcagttcaggactcttgccttggtttttgataaattttcaaagggaatcagattccctgcagggtggagcataacatcatacagcagctaccagtgggaatgattcaccaaagccaaaagtcacatgggagccatcacacatacctcatcaagatctgatgggagggttgaacgtggtgactcatgcctgtaatcccagcactttgggaggccgaggcgggctgatcacctgaggtcaggagttcaagaccagccttgccaacatggtgaaaccctgtctctactaaaaatacaaaagttagccaggcgtggtggtgtgcacctgtaatcccaactacttgggaggctgaggcaggagaatcgcttgaacccaggaggcagtggttgcagtgagccgagatcatgccactgcactccagcctgggcaacagagcaagactgtttaaaaaaaaaatctgatggaaggaatttaggaatttagtttcttgtgtgatacagagaggtgtacttgacttggcagttgttgataatctgggttcctactttattagtgccagtttaatattgtttaccttgaactttgaaagaaattaaaaaaaaattatttgaaaaaattttccctctactgtcccttttctatgttattattcatatgcctgaagcataaggttcggatttagatactaaggcattttttaattttttatgttattttattttgaaatggagtctgctctgtcacccaggctggagtgtagtggtacgatctcagctcactgaaacctctgcctcctaagttcaagcaattcttgtgccttagcctgccaaatagctggaactacaggtgcatgccaccacgaccagctaattttttttgtatttttagtggagacagtgttttgccatgttggccaggctggtttccaactcctgaccttaggtgatcctgacctcaggtgaccttggcctcccaaagtgctgggattacaggtgtgacccaccacgcctggccactaaggcattttttaaattaaaaattccattgtgataatttttgtgtactaaaactccgtaaccctctaactggaacaatgtccattataatatgaaaactgggattatcttcatgatgattctaatttgactgtatttgactgtacagtctaatttgacatttgactgtacattttcccctgatgtcttcaaagggcaaatatagcttccaaacaagaattgccatggatccttggataagggtggcttcttcaaagatatatgggacttgtgcttagtaaaattgtgaggttggtaaaatttgtattcgaagccttcctgccaccactaccatgatcctggaggcaggtcttcagcttcacatactcagaaacttcatttcctcagcacacatgcatctctcaggggctgattttttactttgttgtgaaaatggaatggtaatggtgaagcattctaggaagatttctgttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggattttgctcacagacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaatttcccggagagcccattaatcttattattctcagtcatagtaaccagactggtgatttatgtctctatgatgtctataaattggcttcctatggttccacaaagcttatctacttttcagaatgagagtgtatatactcagcacatatagcaatgtttgaaatttatacatatatatgaggtagtcaaaatagtcaaacagtagagaaagaggtttaatgaaaagtctctcttcagccctcaggccctcctcctttacttccttacccagaagtaaccatgattactggattttttttttgagacagggtctcactgcattgtccaggctagagtgcaatcttggctcactgcagcctcccgctcccaggctcaagtgatcctcccacctcagcctcatgagtagctgggactataggcatgagccaccatacctggccaatttttttttgtacagatggggttttgccattttgcccaggctggtctcgaactcctgggcttaagtgatctgcctgcctcagcctcccaaagtgctgggattataggcatgagccactgagcctggcatgattcctggattcttaaagcatccctttttaaccttaattttcctggtacagtgcatctacttctaagtgaattttgataatcatattgtttcctttaaaattgcttttagagagttgatatgttagcattgtaggtttataggtaaatttcatgtttatacctttaaaatgtgggaaattgttgtatctacaccagggtttctcaatggtgacactagtgacatttgctgaagggtttgttgtaggaggaggggggctgttgtgtgcattgtaggatgtttagcagcgtccttgacctctacttactagatgctggtaacctccccctcccaagttaggacaataaaaagtgttcgatattaccaaatgtctctgagagcggtagggagaacaaaatcagccccaattgagaatcactgatctataccatttgataacttttttgataaaaaaagcaccacatttagacatgctaatgtttcattatataagtgtgtgttagctgaagcaatgcctttttcaattttctaaccttagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtaacaactgaaagcgctatctcttggtgtttagagaataaatctgaatgctccaatgcttttgtgcattgttcattaattaattcaattctcaaacattttctgagtctaataagtgccaggcattgtactaggtgctagcagctcaatgaaaatatgagtatgtctctgccttgaagaagcttacaaacaacttgaataacaatgcctaatagttatataaaatttaataatttaaaaaatgatatacacatgcacgcgcgcgcacacacacactcacacacacacacacgcacacccctcctttagatcgagagtcacaagcttatcttgtgaagtgagtaaggcatgtattattaccctgatccattttatgaggaagaaaggaactgcgtgacttgctgtatgtcttcacatttcaggcccagtgctttaaaaataaaacacaaaatactctcttacccattatgtgtgatacttagtttgatatgcaggatatatttgggaaaagatgttgtttaaagagaaaaatattatgctggcctggctccaatacaagtctagacaagatagtacaagacaaccttaggaaaagctgtcaagtagtgaggatgatcattgttccccaatcccacctctcccaatgtccttctggctcttatgttacatacagggagtagcatatactgattaagagcagggctaccagaaaccaactgtctaactttaaatcccagctctgccagctactagctgtgtaaccttgggcaaatttcttagcccctctgcaccttagtttcctcatctgtaaactgggcatgatgatagtatctatctcctagaattattgggatgattacgtaagtcagtatatgtgaggtacttagaatagtgcctggcaaagagtgaatgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcaggactgccaggagatttgaaacaacttacctgccctattctcctttccttaggagttaacgaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatcacatgactgcactccagtctgggtgacagagcaagactctgtctcaaaaaaataataattactatactatgacataaaatggttgatgatggctcagtgtagtaccccttcaaggatcatgagggataacagatttacattttaaacagaggtgtttaatttaaagacattataccttaactaaaatggctttataaagatagagattttaggtcagaaagatactagggctcttaaagtcatgacacttaagaggcaactactaagagttaaattaggcttacctttccccagaattgcttcaggaggaatgtttgtttgtttgtttatttagagacagagtcttgttctgttgtccaggctggagtgcagtggcaagatcttggctcactgcaacctccacccccctggtttaagcaattcttgtgcctcagcctcccgagtagctgggactaaagatatgtgccaccacacctggctattttttgtatttttagtagagacagggttttgccgagttggccaggctgttcttgaactcctgacctcaaatgatccacccttgttggccttccaaagtgctgggaatacaggcgtgagccaccctgcctggctgaatgtttattttttaaaaaatgtgtcagtattgatcaaaagacagaaagttaaattgtacctcaataattttttaagacagatatatataagggttgtttgtatatccacattcatttaggaattgtgtagatattgtctatgattgaaatagtttttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgtttaattttttctgcaaactcaacaagatggacagtttgcttcaatgaaaaatgcatctgtctttggtgtctactttttaaataaactttctatttttaaatatagatcctgtatattaccagaaaaaatgtacagagagatcccatatactccactcagtttctcccagtggtaacatcttgtgtaactatagtgcattatcaaaaccagaaaattggcattggtacaatccaaaaacctcagtcctatttcaacagttttacatgcactcgtgtgtgtgtatatgtagttgtatgcaattttatcacatgtgaagatatacaatggttgcatcaccataaggagttgctcttttatagccacactcacctccgtcttaaaccatctctccttgtacacccctctcccccaatcctctaacctctggcaaccactaatctgttctccagctctttaattttattatttcaagaatgttactgaaatggaatcctatagtatataaccacttaagactggcttaaaaaaaaaaaactcagcgtaataccctggagatctatacaagtagttgtatatcacgaggccactcctttttatagctcagtagtattccatgatatggatgtaccagttttttaaaccattcattcattaaaggatatctcagttttttccagttttttgctattatgaataaagctactgtaaatattcacatacagatttttatatgaacataacttttcatttctctggaataaatgcccaagagtgcaattgctgggtcatatagtaatggcttatttagtttttttttttaatgccaaactgttttctaaagaagttagttcaccttacatttccactagcaatgcatgagttattgatgtctacttttaaaaaggaaaatgatatgtccggggtcaaaaagttgtttgtttgtttatttatgtttttgagatagagtcttgctctgtcacccaggctagagtgcagtggtgagatctaggctcactgcaacctctgcctcctgggttcaagtgattctcctgcctcagcttcccaagcagctggaattacatgcatgcaccaccatgcctggctaatttttgtatttttggtagaaacagggtttcaacgtgttggccaggctggtctcgaactcctggcctcaagtgatctgcccatctcggcctcccaaagtgctgggattacaggtgtgagccaccacacccagcctcaaaaagtagtttagcttcctgcaaaacaactttgatattttgatatttgatactttagtatttggtatttgtgactatatctactacaaagtttgttaaatttctaagttagtcttccatcattccctttagagcctagaattattagcaacagaacaaggaagaaagaccagattaatccagtttaattcagtaaacctttatttagaacactttgtggataaaccactgaatgcacagcagagacaaaaaacatatctcttctctcctaaagctcaaaatatagaggagaagatagtgcctgatacagtgacctgcattaaattaagtaagacagtgtatgctgaaggctgttgcagagggatagatagattcctgtgggaagttaggttggagcttggggtggtggtcgaggggaggtggatgggtggatggagaggggactgagaggctttgatgaaggaggaagactgcctagatgggggagtttctctgatgctggcctctggggaagagcattttgagaaatggaggtatttaatcgttgtgatgtcagggtggagaaggggagacctagcataggcagtctgcctctacatggccttgttccctgactgtcatttgttaagacttcttctgagagaatgggatgtggagagccatgtccaagacttgtgaagctactggataaacatggcctttcatgctagagtgtctattttgcctgatgacatgatggaaagcatttttgatacattaaaacactcatggctatatcatggaatagaatgcaaaaaaaaaaaaaaaaaaagtaacacacatttttggatgaaaacctccaaagttgccccaggattcacatccgcactcctccctggtggaaggatcctcctggcaaagttgggaaatcctgcaggtggagccagaagttctgtgtggttatgtctgaggtctgtttctttttccccccctgatgtaaatctcatttgaggttttgtagtttcacctgctcactcttggtacctgttgtttctcctttacttaaaacccttcagtggctccctggtggctttaggttaaagtccaaactctccagcatgacagacaaatcgctttatgacagacctggcccctgtcaacctctccagactcggttgcatctgcctccatgcacccccgcccctcttgcagcctaccattcgcccgcagcaaacttctttcagttcctcagactgctttcttcaaatactcaaacacaacactagatttcaaacagaatattcaaacagaatagtggaaacattctgcatcctcttgtagcctaggcctttccttttcatttggatgcctcttatttgtctttatccttatttcagcccagacaccatttcctctccagaaagccttccttgacctctcaagtctagacatgtgtcccttcctcttgtctcacggcaccttgcaatttcttgtgtcatactacccagcacattgtgttgtcatttcctgttacttggtggtagcctgctacaggcttcagtttctcttgagagcgggagctgtgtcttgtttctcctggtgcctgatatatagtaggtattccataaataagttgtgaatgtttggtaggatccaaagctagagaatattcagggttgcggtgatgacttatgaggtataagcaactgaggaatattatggttcatgaataaaaagagagaaggattgagtagatccagctccctaaagaattgctaagaaggggccaaagaactaagccttactaagaaggagtagcctggctgttgatgttgtagtaaagtttagggagagctgttacacaggcttttaagatgtcttgtgagttggcagcatccatgtgtttattatgctattaacccctcttgttttccctggaatcattattggtaaaaccgcagggaaaacctttaaagaatctatgtctatataagggactggaaaagaagggaagaagtcttaaaactgtatctcattccatggcagactgggtagaaaattatcccagctattagaatcagggtggcactggaggcagatggtagcctagtccttggggttcttctaagacaaaaatagggaagtgccttggggatatactagcaaaaacaaagtctcaatgcaaattgttaaaagaatgtttcctctgggtgaatgaattacaaaaaaacctggactgaccaatttgaaaaagcattcctcttcctctgggctgaagcaggctctcaccaaagctgagagcagatggtacttgggctggctttcagccctcagttgatgtctttttgcagggaacaatctgcacagccactggaggtcgctcaagatgcaattccaagatagtggtgggtcactagcatccaagggggcagatatcaaggatcctacttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatatacagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatgtagagtaagtgctcaatccataatagctattattactattggccaggcgtggtggctcacgcctgtaatcccagcactttgggaggctgaggcaggtggatcatgaggtcaggagatccagaccatcctggctaacacagtgaaaccccgtctctactaaaaatacaaaaaaatagccaggcgtggtggcgggcacctgtagtcccagctactcaggaggctgaggcaggagaatggtgtgaacccgggaggcggagcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaaaaagggatcaagaagattgtgcattcgaggagttcctttcatcattaaaaacaattttacacatggctttctttagttatgtaagaaaaatgtcattaaatttcttcagtttctgtttttggccatgggcggaaaacattccaggacagtctgatccaaaaactagtcatgacaataacttcatttttacaacactgttttcttcataaaccacagggcgctgcaactagggggaaaagcttatgtactacctattgaaggaaaaaagcattttctatatcgaagcattcctttgtgcagcctttgaaggaataaatacattagctctgagtttttttttttttaaactgacttgcagcagaatctcctggagaattgctgttcaaatgctggttcctaggtcctggcaaaaccttctaaatcagattttctgggagagggtttgagaaacctgcattttaaagtagtacagaggattctgaggtaacaggttaaggatttgggactctttactcttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattgtgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaacagtttggtggagaagagggtgcatgatgtgttttggacactggatttgaggcaatggtagaacactcaaatggagcagttggagatctgggatttgttctgaggtgagatgtcaggattaggaattaccagcatagaaactgtagttgaaggatgagggagtgataaactggatgtgagtggatgagggagtcagaaagagggaagaatgtgagtagtcctcctactccccctctgctggaagagagaggagggaacagaacaagccaagaaacaaggaaggagcagggcagagggaccagaggaggaatcgtagacttcagcagataggcattttcaagaagcatgaaacttctaatcccagccttagaatgtcttctcttatacagaagaaataggcctcctgtagtctctatagctgctgacagtaccagtgttcatcaaaaaggaacaatctaggctgggtgcaggggctcacgcctgtaatcccagcagtttgggaggccgaggcgggtggatcacttgtggtcaggagttcgagaccagcctggccaacatgctgaacccgtctccactaaaaatacaaaaattagccgggcgtagtagtgtgtgcctgtaatcccagctactcaggaggcatgagattcactggaactcgggaggcggaggctgcagtcagctgagatcgtgccactgtactccagcctgggcagacagagtgagactctgtctcaaaaaaaaaaaaaaaaaaaagcagaaaacagtcttttcttcctagcatatgaaatgagtcacattgtacaatagggtttttttaaaaaaagttatcttgcccattgcaaatattgcttttcatggacatctcagtcattaaaaagaattctgccttttttttttttttttttttttttttttttgtggaagggtcttactcggtcacccaggctggagtgcagtggtgcaatctcagttcactgcaacctctgcctcccaggttcaagagattctccttcctcagcctcctgagtaggtgggattacaagcacctgccaccacacccggctaatttttgtatttttggtagagacagggtttcaccatgttggcaaggctggtttccaactcctgacctcaagtgatccgcctgcctcagcctccaaaagtgctgggattacaggtgtgagccaccgcgcccagcctgctcttatttcttgaatactctgttgaatataatgcagaagattgtctcattttatcttgtaggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtaagttttagaagtcctctaaaacagtatggataaaaagtgtgttatatcttttgcacaatcaatacaaataataaaaaatgatcattctgggtttaagatcttctgaaagaagggactatattgatgtataactttctttgatagatcctttttaaagaagtaaacttggaaattctttttattgaacacatgtgccagatgctttatccttgtttagagtacactgagagttagaacagttagttgtagaaccaacattggaattgtcttagttcattttttgtttggtattttctggtattctgttgcttataacagaataccagagactgggtaatttataaagaaaaggaatttatttcttagagttctggaggcagggaagtggaaggtcaaggggccaagtctgatgagtgccttcttgtttgtggggactttctgcaaagtcccaagacagcacagggcatcacatggttagggagttgagcatgctagctcaggtctctcttcctctttgtatacatccacgagtcccactcccatgataatccattaatcggtcaatagatcaatcaattcatgaaggcagaaccctcatgacccaattatctctttaaaggtccaacctctccatactgccacattggggatgaagtttcaacatgagtttgggagaagataaacattcaaatcatagcaggaacccaggccatctgactctaaggtctagtctcttgatacttaaagaggatgatactcataatgatcatatgtagttcctaaataatctgtctcttagaaaaggcatagacttaaggtagtgtaatcgggtgatattcaaaatatttaacattctgtatggcatgggcactgatcagttagaaaaaccagtatagccttaactgtgggtgccagctgcatgtcagcctgttagaaagcaccctcagcttgaacacagattatctgattaggttctaactccttcactttgggcaaggcatataaacccccttcaaatatttccttatctgtgaaatggaatatataatctccctctatctaaaaaaattgtcataaggtccaaatgacataaagcgtattaacacattgtgtaaattactaaagcaaattccattagcgtaatggtttatttgttgaaatatcccaactgggagctcagattctggcttagatagtcatagaagtgaattctaatagggtaccaaagtcagcttactttgtaggccaagggagtgaggttggagtattttgcctagtggggtaagctgaagcagagcccttctctttgtttggcagattatcttagatgatcttttaagtcttattttgctgttttcctctctggatattaatggtgacataaaggaagaaggaagatccttctcagatagaagatgatatcttcaagttgttttctgttaattacccattatcttctattgcttggtcttaagtatagctgactcctgaaaaagtaaattgaccaggctaatgcatttttaaaaataaattatttttttctttttctgagacagggtctctgttgcccaggctggaatgcagtggcgtgatcacagctcactgcagccttgacctcccgggctcaagctatcctcccatctcagcctccctagtacctgggaccacaggcatgtgccaccacgccaggctaatttttgtattttttgtagagacggggttttgccatgtttcgcaggctggtctcaatctcctgagctcaagcgatctacccaccttggctcccaaagtattttactcttaattgtggttataaacacacaacattaaaattaccatcataaacattttaagtgtacagttcggtagtgttaagtatattcacattgttatgcagcagctctttagaactttttcatcttgcaaaaccgaactctgttcattaaacattaatttcccctcccctccgcccttagcaaccacctttctactttctgtttctatgaatttgactacttaagatacctcataggagtggattcatacaatatttgtcttttgtgactggcttattttacctagcataatttccttgaagtgcatttatgttgcagtgtgtgtcagagactaagccaatgttttaatggtggtctttgattggcattaataagtgacaactagggaagccccttgtatctggtgccttattactcatcaggtggaagtacatctggatccaagcctttctttattctctatgttgcgtctagatgtcctgattataccctggccattttctaaccagatgcaggtcagagttcatatcatctgctagataccccaaatatgttccttaaattcattttactaggcagttttaaataaacttcttctataattgtggctaaatagaaattctaaaactatgtatctgatcatgaaaggccactaaatgcatcagctctgttttgatttaactttatgaaccctgcatatatctgcagttgtctctcagtatttgtgagggattgcttccaggaacttccaaggataccaaaatccatggatgctcaagtccctgataaaaagtagcatagtacttgcatataacctatgcatattttctcacatactttaaatcatgtctacattacttataatacctaatacaatgtaaatgctatgtaaatagttgttatattatctagggaataaatgagaagaaaaaactctgtacatgttcagcacagatgctattttttaaaaaatattttcagttcatggttggttgaattcatgaatgtggaatccatggatatggagggccgactgtgtgtttgtgtgtataatcaagctttggaagcttacttgtgttctatttttgtttttcagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcctattaaacgataattcatttgctcaacacgttcttattaaatatccaccacatgccaagcactcttttgtgtgctagggataaggcagtgaacatgacacctgacaagtttttttcttcatgaaacctacataatagaaaacgtaagtaaataagcaagctaatttcagaggatgagtgctgtgaagaaaataaaatgggctgatgtagtagagtgactgggagaacgagagggaatattaggtagggaaatcatctgaggtaataacatttgagatgagaccagaatgatgagcagacgctagccatgtgaagatctgggtgtagggggtcagcagatacagactctgaggcaaaaatgagcttagcatgtgtgagagaacagaaaggagggtggtgtgaacaaaatgtagcaggaaaagatgtctaagcagtaggcagacatcagatcttgcggacactttggaggctctgataataccattctgttttcttggagtttgtggcaactaaagtaatcagatttgagtagtcaatatttgttggattatgtgcctgtatgctattcagaatcaaatgcagaacatgctaattagaggccctgtaggacactgaccagagtgtactataatctcaggacatcagtccagttgttctgctttagggtaaaggtcacaaactagggcctcacacttttttgtgtggaacacaaagtcgtgttttgtttgtttgtttgtttactagatttgaattttttgcccagattttaaatcatagtactttaagagtgtgtgtccataagatggcgccttaagaccatgaagactgcaccactcacttgtctgctacctgcctggaccctttgtgtgtttgagttttagagattagaagtgaagtgttttatattggcttttaaaggagcctagcatctcgcacgtgggtaaattccttggtccagttgttttagctcatcatggaacttccaaaatgcttgctaaaataagccagtgttgacaggctataattccaactccagagggagtgaccaagtccacagcagaacagaacagcaaatgctcttctgggcatttgcattatgaatccttctgctgaaatataataatcattactagtaccagaaattaagtgccccatgaaatgcagcaaagggaaaaatctaagggctttcatgtggaagggggctggtacttgaatttacaacaaaaggagttatcagaaagctgaaatacacttgtttactccagtctttactgttctctcctgtctgaaatcctgagatgcatgtctgaaatcctgagatagtattcattttgccactcaattattttctgctgtttaacctatcacatgtatgcattttctctccactgaaaatatagactcctacagaaaaccaaatgccacatgttctcacttataagtgggagctggacaatgagaacacatggacacatggaggtgaacaacacatactggggcctgtgggggctgtggtgggaggagggagagcatcaggaagaacaactaatggatactggccttaatacctgggtgatgggttgatctgtgcagcaaaccactatggcacacttttacctatgtcacaaacctacacaccctgcacatgtacctcagaatttaaaagttgatattttttaaaaaaagaaaatatagacttctgtaggaaggagtttggtgctgtctactttgtgcagttcctgctactaaatagcagctaacctgtattgagtgattactatgtgctaggtatcttaataagcactatatctgaattgtttcatttaatcttcacaataaccctaaggatctaggtcctgttattttgtctccattttacaagataagaaaacttagttactcctaaggtcacatttttagtaagtggtagaatcaacatttaaccaaagttgtaacgctaagacttggattcttaaccgctagagaacacctcaatacttcctcttaatagcaatagctatcattcattaagtgtttatggcatgctacaaagatgctcttctatgtgcttcttaatacagtagctcatagcaacccatgaaatagaaactattttaacctacattttattgaaaaaactaaggctcagagaggttaagtaacttgctacaagccacacagctaataagtcagtaacacttcaaaggttggttggtctccatgtatttaactttgaccaagaatacttagcataatgtcatgtgcacaatcatcatttaataaattattattgaattgagttactttttttttttttacaaacttctgaactgaagagaacacatacactatggaagttatctacctaaatcagaactattttctatttggaattaactctgtttgtacacttgagtttaatattcttcctcctagcagatgtagaatgtcatcagttttttgtgtgctcacagattttgaactctgctgcttagatttttctttttttttcctttttgaggaattattttgcctggtgttacacttaagagggggaagtaagcgggaacatgaactggtaccaacacatgggggctgtggtcagaggtagctcatgacagaattatgaagtaaggaacaacttgtctgtgaccaccccccaccccccacccccaccttcccagcagactatcttcttggtgccctggctttccttctcttagtggtctctgaagagccagtaaactatgcagggggatttacatttgaacaagagcctagagacgtaaatctacaggttgattcggcaagtttggaatttctatatatgggagatggtccaggggaggagggacatcaatttgcaacttgatccctcactggtagttgacgcttgtgattccccaacaggtctacgattctaaatggccagtaatagggtatactagccccctgagtggggttttttttttctcaacctctgtatgaaatattgaaaggatgtcccttcatcatttgcttggcctctcagctctttacacaggctggtaggaactatttagtgaatgacattgaatgtcaaaaataatatctatgtgttctggtcttggttccaagtttaaacgtctctttgatagaagttgactatttaagcaacagattttcatgtgttttttactccattttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactgagttataatacatgaacaaaattacacaaatcataacctatagctcaatgatttttcacaaatgatttttcacctatgtaaccagcaccacagaagcccccttcagttgctgtcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacatgccatcaagcccagctttttttttttttttgtattttttagtagagacgaggtttcgccatgttaggcaggctcctggctctcgaactcctggcctcatgtgatccaccctcctcagcctcccaaagtgctgggattacaggcgtgagccactgtgcctggcccagaatgtacttttttgtgtgtttgccctttttttcactcaacattatgtttatgagattcaccaatgttgtttcttatagctgtagatggcacgttctcactacattcattccattgtgtgaatataccatactttatccattctcccattgatggacgtttggatagtttcccatttggttttatgaatggagttcttatgaacgttcacatacttgtctcttggtacacatgtgcgtacatttgtatggggcatttatataggcatatgtgggtcataaggttacatatgattgtctctagtagataataacagttttcctggatggttgtgccagtttacactactaagcagaaattgtgagttctagatgcttcatatcctcacaacacttgttgttgtcaggtaagtgtgtgtattgttatcttgtggatttaatttgcatttttctcatgaccagtgatgttgaacactttttcagatgtttattcgcaacttgcttatcctcttatgaagtgcctgttcaagtcttttgccagtttttttaaaattgggttttctgtttttgccttattagtagggtaagaaaaaatacatatgcaagtcctttgtcagaaattgcaaatatgttctcacactctatgcattgcctgtttatttccctataaggtgtcatttgatcaacaaatgtttttaattttaatatggatgactttattaaaaaattctctttatggttaatatgggaggtttttttggtcttgtttaagaaatatttcccttcttcaaggtcattaagatattctctgtttttatctaaaagcttgctatagttatgtatttattaattcattttatcttacacatttaaatctgcaatatatcaggaactgattttgtgaatagtatgaggtagggcgtcaagaatctttttttttttcatatgcatatgtaattgacccagcaccatttattaaaaaaggccaaccttttttcactgtacctgatcatcttttaatgggataaaaggaaagcttgttagaaatgactaggtgatagaaaatgggtttttaaacatttaggactcattagtttatttatttatttttattttcaaggtccaagaggctaaatgtgagaatccagaatttgagagaaatgtggaggtcagtaaattcaacattagctatttgggtttagacttagagcagttgggggtggagcatagcctaaatatgagctgctttgagaaaaacaaattacgttgttccgtgagttattgacaattttttcgaaaagtcaaagataatttgaattgcaatccaagtcttaatcatagacagaatttggcagataattgtattatgattcaataacagtgaaaaagaataaactggtaatattccttgtgtatttttattttatgcctaagaatacatcttgtttcatggtccctggtgttcttcctgatactttgaacacagtcagaataagagtcaaaacaaataagttatgctatgaggatgacaaactctggagtaattggagccaagaaatgagtataggtaagagaacagaatttttattaaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagggttaattgacagtatacagttatttagaaaaccataatccaaatggttttatgttcttttctatctcatttccatttttattaacaaactgaacaaaaatatagaaagcaggcataggctgcacacagtgactcacgcctgtgatcccagcactttgagaggctgaggcaggaggatcgcttgagcccaggagttggagaccagcctgagcaacatggtgaaaccccatctctacaaaaaatacaaaaattaaccagatatggtggtgcacgcttgtggtcttggctacccaagaggcagagatgggaagatctcttgagcctgggaggcggaggttacagtgagctgagattgtgccactgccctccagcctgggcgacagagtgagaccgtctcaaggaagaagaaaaaaaaaaggcaggcataataaaatttgcacattgtacaatactagagactgtcctacatgctggttggcagaaacaagagtggagccatttaatagaaacctgtacctaagtttgaaaaaaatcatttattaattgaaaggctgagcaagctaggctcaagtacaggactggaaagacctgtgctttatggatgtgtgtgtggtggggtgggatacacggctttataagtgcaatgtgactcaacattgtaatcttaaatgtgtcaaaaaggcatatacaatcttaggagtgataagtgcagcacccagaaaggaatgctgcaggttggggcacagagctatggtcacatcagaattgtgcagtattccattctgagcaccacattaaaggagttgccttggcagactggaatctatccttgaaaggataatcaggatgttgaagaatctcaaaacttggcaaggaacaattggtaaagtaactttgaggagtcatgattgctgatttctaatatttgaggtattgtcaggtacaagaaggaataggctttactttttgtgtctccaaggggcaacacagaaccaacttaagaactttttaaacagctgtatattggtcaaacaggttgtcgaggtagccaattccctattaattgagaagctcaacaagttatgtgccaggcatggttgtattcgtttatttattgttgtataacaaattactccaaagtttaatggcttgaaccaacatacatttaccatctcacagtttcggtgagtcaggagtctagccacggcttagctggaggtctcatgaggttgcagtcaagctgcaatgagaactgaaatatgtctgaaggcttgactggggacagagcatccatttccaagttcactcatatagttgttggaaagcctcagtacctcactggttgctggatggaggctgttgcaggttgaattgtatctcccaaaaaggtatgttcgtaggttccaaccccggtacctgtgaatgtaaccttatttggaaataggatttttgcagatataatcaagtgaggatgaggtcatgctggattaaagtggacagttaatctaatgactagtatccttataaaaagagaagccacacagagacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgcttcccttagttccttgccacttggacctccccatagggctacttcctgacatggaaactggctttcccaagtgagtaatccaagcaagaaacagtgtgagagaacacgcaatatgggaaccatggtcttttataacctaaccttagaaatgacatcccattactgctgctgttctgttttttagaagtgagtcaattagtctagcccatgctcaaggagaggggattacaccagggaatgaatatcaggaggcaggaatcatgtggagaaatcttagtgactgcctaaaacaatggtgccaggccttgatgatgctttctagatgttcatgacctagtgggaaaaatgaatttgtatatagacaaatgacagtctatatgttagatgtagcaaggcaggctttggaattggacagtggaactggaatttgaggcctgatgccattatttactaaatccttccggatgacttactaaacctctctgagccttatctttctcatctgcttaaatgggagataatgctatcattatagcatatatatgagataagcatgcaaaaccacctagtgtggtatcagacatatagtaggtgcttatttaagaataatagtagttgttaggattattttaggtattttagtagtggtaagtaaccagtaaaatatgtagtcactgttaataagattacatatttaatatagcatctttgttaatagtatttaaaactagttaagatcttctgatttacctgagcgggtggggaaacccaccccatgagcatcccctgggctcacccagtgcacagagggaggcctcccgtggctgggcccctctcagtcagcccatgtggctgccatgacctggagcaccacagccgggggcgcccaccagctcaacaccaccacattcacgtggcagcacctccctgcctggcaaccgctgctgttggccagcattaggctgcagctcttcttctacgtgggcctggccttcatcagcctggacctctattactcctccaccagcatcaaggagctggagtacaactacaccggcgacccgggcaccagcaactgctcggtgtgtgctgtggctggccagggctgtgtgccactgcccatctgctcatgcgcctggtacttctcactgcctgagctcttccagggccctgtgtacccctactacgtgctgaccaacttctaccaaaacaaccggcggtatggagtgtccgcgacaacgcgcagctgagcgggctgcccagcacgctgcaccatccagtcaatgagtgcacccactgcgccgcctgcccatcgtgcaccctgcaatgtcatcaccaacagcctcttcaacgactcctcgctgtggcaccagtgctggcccggcgagccctacgtggaggtgccgcgctaccgcactgcacctgcatcacccggtagaccaactaccccatcaagttctgcaacccaccactggtcaacggcagcctggcactggccttccatggcacagcacccctgcccaactggcgctggctggtctacgacaagctcagccccatccccaacaacaacggcttcatcaaccaggacttcgtggtgtggatgcgcatggcagcgctgcccacgttccgcaagctgttccgcaagctgtacgggcacatccgccagggcaactactcagctgggctgccgcggtgtgtctactgtgtcaacatcacctacaactacctggtgcgtgcatttggcggccacaggctccgcatcttcagcagcatcttgtggatgggtggcaggaaccccttcctgtgcatcgcctatgtggtggtcagctccctctgcatccttactggctttgtcatgctggtcatctacattagctaccaggacctaccagaaagatgatgacaatgaggaggaggggtgattccagctttccaacgacccttcctgcttcttaccaaaattctgcaagcttttttcagtctctcccctttgcctctcatcctattccaacctctcctcacttttcctccctttgtgaatgagggggccagagaagggaattacccacttactcttgggggctgctaaactctgttgcctggtggcggagggttgactgcagagtgaaacatccttgcaaactctccccacctccttcatgatgctgagatgccatgttaggttctccaagtccaagagtggaagggatccttatagagactcattttcaacccctaccagaggaagagattgagagacctagcaacatcaaataactcaatcaagatcaggcagctggcaagtggttcctgacgctaaggctagagcttttgccactacagtacagtggttttcttttctttgtggggagggtgggttgggatggagagtgagacccacaaattatctgcagaggcatggaggggtgtgggagaacatatttgttaaatatgcagatagatgaggaggcaccaaccccagagattctgacacagtaatgctggggtgagatgcttgaaactgtgttttaacaaactcctctggagattcctgtattctctcaaatttggaaatcactaccctgaacctggttgggcctgaagcagtcacctgagtccagtttttcagatagtaatttgttcccagggacagtgacaccataatgttgcaggtttggtctggcactctgccttaaatatagtatgctctaatgacttgtggaatgaatttttaaaaaatcactatctctgggctgggcgccatggctcatgcctataatcccatcactttgggaggctgaggcgggtggatcacttgaggtcaggagtacaagaccactctggccaacatggtgaaaccctctctctactgaaatataaaaataagctgggcatggtggcagatgcctgtagttctagctcccgggaggctgaggcaggagaatcgcttgaacccgggaggcggaggttgcattgagtcgagatcgtgccactgcactccagcctgggtgacagagtgagactctgtctcaaaaaaattaaattaaaaaaaatcactatctctggaaaactagttggtgtacagatttgtaggccagggtttgtgtcgatttatttgatattttagtataacagcaaacaggcaaactttaccagatactgtgtagaaatttgaaaatgtgaggccagtttgtacagttcagagggaatgctttttaactgtagaatcagatagctggaagggatctttgagggaaagtaatttccctagtcacatctatgtctcctggctcagtcttctttgtcatttaatctgtgtgtgtgggtgtgtgcgtgcgcacacgtgcgtacttacaaagggcttcattcataccttttctcttggatctggaaaaaatttttttatgttttccaatgagatacatttgtagtaatcatatttgaaacaatgctaaggtatatatagtcttatatgtaaactagaatcttaacattatttgaatcttggagataatgttaaaagtcttagctaaaatgattccattgattttatcgattgactaacatcaatcaatatgtttaaagttattctaagaagcaatatttttatttaaaaaaacctttctttcatggcaaaatagcttaaaagaactttaaaaaaaaaccctatgtgatatgttccagtttatttgctaaaagcaaacagttatttggtatttgtcagacagaattcttcagtacctgctttctattatagctattttccagttaccactcattcgtttatactccttcctttaaagcagcacaagatcttgaagttttttttttatcagttaagaaatattggattgtattggatagtatacatagtttagtctgttagttctctgaaagttactgaacaatggacaatgtgcatgtcactgacatccgtctcagatcttctgggacaactatgatttaagagattctatctcattattacagataccaaaaaaatacttgggtaattccagtgtgttggctttccaactcctgaacactacacaattttattatcagtttttgtatggtgattttaggctatgaaaacattattttatgtacatagagaaatttttattatgaatgtttgagctcactagcccagccctcctctattttgaaaaagagagtttactacattttttactatgtagttgaaaacaacatgtattttgtcatttttagaatggtcagtctatttctataaaattttaaatgtggctgggcgcagtggctcatgcctgtaatcccagcaatttgtgaggctgaggcggacagaacacttgaggtcaagagtttaagaccagcctggcccaaatagggaaaccccgtctctactaaaaatacaaaaattaactcggtgtggtggtgtgcgcctgtagtcccagctactcaggaggctgaggcaggagaatctcttgaaacatggaggcggaggttgcagtgagccaagatcgtgctattgcactccagcctgggtgacagagtgagagactctgtctcaaaacaaacaaacaaacaaaagtttaaatgagaccatcaaatttaagggattctgatccagattaaattaatgaatatggttccaggtcctagtctctgagtttttgaaagagaataaagcttatgtttgtcttttaaaaaatatcctaatttcaggtaatcttttaggtatttgctcgcctagggaagttcaggcaccagaggaggactttttttttttaaactattaatttaacagaagataagataattgaagagcttgggaaaataggttgggggagggagcagaaatatttgtgatcttactagctaacagaattgctgcttggtttattactaaaagggttttatttctcaagtctttctgtttgcttttcattctccaggtaagaagcgcaattccacactctacataaccatgttactcattgttccagtcatcgtcgcaggtgcaatcatagtactcctgctttacctaaaaaggtaaggtagctgcccaggcaggttttgcagtttctgatagcctgtttgctgtggttattacttttagtgcttgtgttttatgtctgcccagtgtattagaagcatgttgcctgtaagtggctttcgggagtatgacatgacaaggaagtattaccacgcccactttcttttcttttcttttttttttttttttcctgagatggagtctctgttgcccaggctggagcgcagtggtgtgatctcggctcactgcagcctccacctcctgggttcaagcaattctcctgcctcagcctcccgagtagctgcgattacaggtgcccaccaccacgcccggctaattttttgtatttttagtagacagggtttcaccatgttggccaggctcgtctcaaactcctgacctcaagtgatccaccctcctcagcctcccaaagtgctgggattataggcatgagccactgcacccagccgctatgcccactttctaatgaaaaccatgttggattagttttccagggctccctgctcaagcactgctgcctttgcatgtgtttaggattgttgaataggtcctatgttcacataatactctttcaaatgcctaatctatcaagttagtcagtagttcttagaatgaagttttagaaatggagacctttactaataaaatgacttgtctggtattaatgcaaagtaggctactacttaatattgtgggaaagagaacttcatcaagttgtcatgaatgtatggtatccattccttgagaatattttattttctctatctcattataggactgttatttgctcttgtagtaaataactaaggttgaaataaggttattaagttggatccagaaccaatattttatcattatttcaacatttattcaacatatatatatactctctctatatatgtatattttttgagtgcctatttgtgaaccaggtactgttctaagtgctaaagttacagcagtgaacaggacaaagtcctcatctacattctagagggaaagatacacacatgcacatacacacacacacacaaaataaataataaatactataatttcacttagaagtataattgacagtagtggggtatggctaggaggtgataggaggtgcattttatgtaggatgtcaccaagaaagtgacatttgaggagagactcccagtaatgtaaaggagtgaatcattcagatattcgaggaaagagcactccaggccatgggaacagcaaatgcaaagtccccaaggctgaaatgcacttggtttgtttggctggagtggagagtgcagggtagagagtggcagcgagggaggacagaggttggccaaccacatcacgcaggccatggcaaggaactgagattttattctaagcatgatgaggagcattggagagttttgagcagagtaggcacatggtctgagttactgtcataaaggattattgtagttgctgagtgaagaactgacttgggcaaaagtggaagccgatggagtagttcggaggcattgcagtgttttggcagaaagatgaggataacctatactagggggttagcaatggagatagcaagaagtggtcagaaatagtatatattttgagagtagaattgataagacttgctgttagttgcctgtctgtggaggtgtgaaggtaattaaggattcagagatacctcttagatttttggcttgagcaactgagtgaatgctggtgccatgtactgagacagagaaggctgtgaggagagctgggtttgagggaaagataaggacttcagttttgcatatgttaagtttgagatgcttattagatatccaaataaggatgttaaataagcgattttgtgcatgaatctggagttgaagggagaggtctgggctgaagatctaattttgggaatcctcggcatgtgaatggatttaaagcctaaagaccgaaaggagtgctcataaagtgaatgagatagacaagaagacaaaaaactgaatcctggggcacatccatggacactcactgggagatggaggcaagctataagattgaaaaatggagagaagtaggaaggaaaaagaaacagaggaatgtatcctgttctcagattattcttttcaaaattatacagagcaagcgcccatctggtctgttaaaagtagagtagcatattatttagatgatagggtataagtaattcatttattctgatggtccctgtgctccacctatgggcaagagtagaacttaatgcccttagaacattgatttttgtgtaccctattttagaaatttcttcacaactgccttgtcaataaagatgacttgtgtaccatgtcttttgtccatgccttcttttaatatggtggtatttatgtgggacactcctatggactggaaggtttgaatcaaatgtctctgttttcttaaaggctcaagattattatattccctccaattcctgatcctggcaagatttttaaagaaatgtttggagaccagaatgatgatactctggtaagaacagatttcatggggcttgaaatgtttttttttttttttttttttggaagctatggcattttttaaaaaagtgtggtaaggtatccataacataaaatttattattttaagcatttttaagtatacagttcaggctgggtatggcagctgacgcctgtaatcccaacactttgggaggctgaggcaggaggatcacttgagcccagcagtttgagaccagcctggacagcatgccactgcacccagctaatttttatatttttttgcgagatctcatttccacaaaatatataaaaattagccgggtgcagcggcatgcacctgtggtcccagctactcaggagattgaggtgggaggatcccttgagcccaggagttcaaggttgcagtgagccatgatcatgccactgcattccagcctggatgacagagcgagactctctaaaaaataaaatatatatgtgtgtatatgtgtgtgtgtatatatatatatatatatatatacacacatacagtttagtgtcattaaatacatttataagttgtacaaccatcgccactatctctttccagaaatttttcatcatcccaaatagaaactgtggctgttaaacaataattccccatcccctcattcctcccacccctggtagcctctattctacttcttgtctctatgaattaaatattctagatacctcctatatgtgaaatcatgcaataatttgtccttttgtgtctggcttatttcatttaccataatgttttaaaggttcattcatgttgtagcatgtatcagaatttccttttgaaattggttcttctaaagtacaatttatttttaaaaatttgaaggagagctgatttaaaatatagtatctgaggccaagcataccagttaaaaagtcttcagaatactttgctcatcttatataactgggctccattctctctctggttaggagacatattttatcaaaacatgcaggaagaagggcctcctttatgaagctagcctaatgagcaggccttctgactcttggataatttaaaaaacttgatgtggggaaatataaacatagggtaagcaattgaaatgcattgtgttcatgttgtttcttggaaggctagactccaaagatatagaaatggagcagccctaccccaactgttatagttggtttcctgcagattctcatgctagaatttgtggccagaaaacctaagacattatgggaacaaaagggtttgaggcttctaactttagttggatttatcatccaccctactgaaataataaagacactaaatgaaataaatattattatcattgtgtatatcttaaaggaataataacaagcatagggcagttaatttagggaagtagtactgcatagtagataatagcctgatttctggagtcagattgtctggattcatatccctgctgtgtcatttaccatctttttgaccttggataattttcttagcttctctgtgactcaattttttcattagtaaaatggaggtaacaatagcacctgcctcatagtgttgttatgtggattaacttaatacccaacagttaattgaatggaaactgcttagcctacctggtaccttgtaagtgcttaataagtgttagtgattagtattactattgataataatttatttttatctttaattcccaaataattattgtaataatgggtgattctcaatggtagtgatgatatttggttagggaaggaaggcagagaggcaaatatgctatcagaagaggattcatttggatcactttttaaccaggtcatcttcacagacagtagataactctgccagaccctgggagtcagggcatgtagacccagaagttaggtacctgatgaggaaattgtatgccgtatctggagcgagtatgatagctatggttctccaactttagttgagtcacagtcaactggagtgcttacaagaaatacagatttctggaccctacttccaattccctgacctgacctgatttggcaggtcagggacgagttctaggactctgcatatttaataggagcccacagatgatccctgtcctgctaagagagtctgtggaccacactttgaaaatcagtgataaagatatttacccctgtctcttacttcatttcaccagctgtgatagatgctggaggttgggaattgtacaagtaccctaacaactttcaccagctattgaaagtctactatgtgtcagacaatgtattaagtgctttgcctatattaccttattgaatcttcataaccaccctatggagaagatgctgttggtattattttacagatgaggaaatggagccccaatgaggttaagcaatttagctgcagtcacacagctagttggtggtaaggtagaatttgacccagggctgtcttaatgctagacttctcttggtctttctactaggctgcattgcctcttgtaagatagaatgcttgttctgaagaacctcaccatcttctaagacatctgtatgacagaagtagagggttggcataggggatttctgagaaaaagatttagggttgtattatgaatagctttaaatgggaagatattggcatgtcttgtatatattaatggcacttttcatgcactgctggtgggcctgtaaaatgatagatatcctttctggagggcaaactggtaaaatgtaacaggaatctttgagcctatgattatacttttaggaaccaattttgaggaaatgatccaacaatggcacaagagtggtcaatgcggcatttgcttttaacatgaaaaattagaagccaatgaaacataacaattgagaattagtttaaaaaaatatgttaggttttcaaagcatttaatgttataacaaaatactcaaaatacaggagtaagaaacttaccataaacatgtagtatattacaatcataatttttatcaaaaatgcattaatatatacatagaacgaggggaaggaaatgggtccgaatgaatgatcatttctaggcaaagggattgtgggtaactgatattactctctctctacctttctaaaatttccagattgcctatagtgagcatgtactacttttataataaaagaaaccctgtacaagtcattaagggaaaaagaaaatactgtagtcatccaggtctgagagataataggaacttgaacttaggtggtagcagaggagattgacgtaagagacattattaaaggaaatcaactcattatgacttggtgagtctgtgtgggtgatgagaggtagggagagtaaaaaataatttcaagttttcaagtctgagtaatagagtgaatgatggtaacattgacagcaaaatcagatcaattatctttctcagagatgggaaaattgcttttttcaatttgctgtctagaggataatatgttgtttttgtcccgatgagtcagataattctgtaatttggtgacgcaaatatactgacaatatggaccattaaaagcacaaggtatttttgttttgtccattgcagaccattaaacaaaatcagttctttaaaactaaaagtataataaaaattccagatatggggaagggtaagagaacaaatttttatgtcggcttttaaccaaatgaaaaaaatctgctttcttcacatggcatcaattctcacaaattgaactgcatatgctgcatactcttttacttctagcatcattgaattattgaatgaacatagccctagaggtcatctaatgaggtggatgttgacatgtttaattatttccctttaattataaatgttcaaaactcgagattctcactcatctccctctctttagagatggggacatgaggagccacagagaagtttctcaaggactgtcactgtgttaagccaatcttgtattgctataaagacatacctgaaactgggtaatttataaataaaagaggtttaattagctcatggttctgcaggcttcacaggaactgtggtgccagcatctgcttctggtgagtatctcaggaagcttacagtcatggtggaaagtgaagggggagcaggcatcttacgtggtgagagtgggaacaagagggggtaggaggtgccatacacttttaaacagctcttatgagaactcactgttgtgatgacagcattaagccatgagggatccacccctatgacccaaacacttcccaccaggccacacttccaacgttggggattacaattcagtatgaaatttggcagggacatatatccaaactgtcagtcacatagagaggcaactgcaaaacctggactagaacccatatagcccaaagttaccaacttccaatccaaataaataatcttgtccttttttaaacactgtcttcttccacactgcaccattaatagttgttcttataaaaacttatttagttatggccatgaataagttaaatcttcagtatagttttccttaaagttactcgtgttttgatgatgttttgttcattactatagtaatgttttggccaacagcatttctttctgttgctttgctatttgccttttccttgtgactaattgggcttctggccatattgaggggaggtaaggggagttgcagagggaattgcttctcctctctatctgcatttctcttatccataaaaaaaaaatctgtcctccccctgcttcttggaaaccaattcttattttcagcattgtgccatttttatattcttgttcagaaaggagctttttaaacatggggataacatccaaatactgctgattgttattttttacttcagtgtgtatcttttttttttcctttttgagatggagtctcattctatcactcaggctggagtgcagtggcacgatcttggctcactgcaaactttgcctcccaggttcaagtgattctcctgcctcagcctcccgagtagctgggactacagatggtgccaccatgcctggctaatttttgtaattttagtagaaatggggttttgccatgttggccaggctggtctcgaactcctgacctcaggtggtccgcccgccttggcctcccaaagtgctgggattacaggcgtgagccaccacgcccagcctcaatatttatctttaaaagctaagaatgctttcctacatagccaaaatagcattactgtactttaaaaattattaattccttaatttcatctaatactcagtccatattcaagtatttccaactgcccaaattgtcaggagacagatattatccagtcatctcaccactgaccactaagacagtggttgagattgaccactatatttaaggtgatacaacagcatgtcccctcctgccatctgcacttatttccccattgcttcaacacagataatctgtgtagtgttatgctagcaccttgtcaagtcttcagctaatgctttttacatcagttgatatccttgcttgaatcagtaatttccttaggggttgggttgaatattacagtttttctctttctatcatttctacatttacttttcttttttttttcttttgagacaggatcttgctctgtcaccgaggctggagggcagtgatgcaacctctgctcactgtagcctcgacctcctgagctcaagcagttttcctgcctcagcctcctgaatagctgggactatagtcacgtgccaccacactcagctaatttttaaatttcttttgtagagacaaggtctcactatgttgcccaggctggtcttgaatttctaggctcaagcgatcctcttgcctcagcctcccaaagtgctgggactacaggcatgagtcaccgtgcctggcccatttctacacttattagctgacaggtatctataaagcgctgctttcagtcatcaactgagctctttagttgttctgaaattcagttcctactaaaaaggcaagatgcatatttaatcatttccctttatttatccattaaggtgaggagttggattaatagacacctcatagtaccaagttattcctctccataccaccacattcaacttggtgtttttttgtttttgctttttttttttgagacagcgtctcactgtgttgcccaggctggaatatagtggtgcaaacatggttcactgcagcctcaacctcctgggctgaggcaatcttctgatctcagcctcccaagtagctgggaatacaggtgtgcactaccacgcccagctaataatttttttttttttttgtatgaatgggcttttgccatgttgcccaggctagtctcaaactcctgggctcaaatgatctgcctgccttggcctcccaaagtgctgggattacaggcatgagctaccgtgctgagcctcaacttgttctttttcaagttgcaatgattttaaggtgtggagatctacaattcattttgtataactttctgttttgaatgataatctgaagagagactggggcatgaaataggtagacttgtataccaaaggccagtgtttttgcatggggctaaggtacatgaagctcacttcacttctgtagacaatccactctggaaaatatcttaaccaaatcttgaaagtaatcttaagttgagacttgatatttcattgtactaccaaatttatgcctttaaattataaaaacctatataacatgccgtttttctaggctcacataattaccaactaaaagccagttgtgtaagccccctaatcactgattttcttcatctatgatgtttttcatctttggccattactctgttgttgattactttgtttttaaaattggcagtaaggattgaattttgggctggtaattgtgtggatttgtttatttttttctacaagtggttttaaaattagacaggcatataattcacagaattgaataataggaaagagccattgcatttatttcttttaccttacatggacatattcatagaagcagtactcaggaaaaggccactgtgttgataaagggtggaaatgagagtaattcaaattttggggatgaaaaaaggcaatcagaaagattaatgtattctgagaagccctttctgttgtagtgttcacctcattaaaacaaattgcttttttcttgtccagcacagccaagtgttggtctaatgaccggaaacaaaagtaattttcagggtgcatttttaatagttatacagtttttatttgtgaaaaatccatattacacacacacacacacacacttcaccactatacattcatgcattttttaaattaaaactttttttttttttctgatcacttgggaggatgaggcaagcggatcacctgaggtcaggagttcgagaccaacctggccaacatggtgaaaccccgtctactaaaaatacaaaattgaccaggcatggtgatgcatgcctgtaatcccagctacttgggaggctgaggcaggagaatcgcttaagcctgggaggcggaggttgtaatgagccgagattgagccactgcactccagcctgggcaacaaaaatgagactctgtcgccaaaaaaaaaaaaaatatatatatatatatatacgtatatatgtatatatatgtatatatatatatatatacgtatatacacatatatacgtatatatattcttttaaaagcaatatacatttagtatagacaaattagaactacagatagtcaagagagaaagacaaaatcactcttaatcctgtcacccagatataactatctttaatggtatgtgaacaacatagggaaactgaaatacctttagtgataaatggagtaatagcaaccacaataataatagttcatacttatggaacctttactatgtgtcttaataacactgtcatattgaattgtatttgaatgtaacaaatgagaattaaaagaatttctgaacttttgatataaaataaattttaatgatgattgaaaagatatttttccatatgctctccccatttgctccccatttttatagttgttgaacatctccattgtgtcctcatatagagccctcatttagtcttacttcagtgtgtggagatacacttgatgctcactaccattttttatgtcaacattgctccagtcatttgggttgtttgaagctggaaagttttctcaggaagtattcatgggaccggcatttcctgaattatttacaaattgatggaatttgctacatttatcattgaaagtcattttggcaaaatataaaatccatggctcataggtcctgcgttgcgtatcttaaatgtgtcatccattttcttctggcataatatgttttgtcagagtcagcagacaatataattttcctcctgtattaaaacacttggtctttttggctggttgtcaaatgatttttttcttcaaagtccaataattttaccagaatatgtgttggcgttgtgattttttgcagtgtatggtgtgctttctcagtatgtaattttagatctttttttttttaattttagtaaaagtttcttcacttacagattttagttattctcttcccatgttttctttgacctttcacatcttttttgttttggcacagggtcttgctctgttggctgggctggagtatggtggcaccatgatagcttattgcagactccaacatctgggctcaagtgatcctcccaactcagcctcctgaatagctgggacaggcatgtgccaccatgcctggctaatttttaaattttttttagagatgcagtcttgctgtgttgcccagtctggtcttgaactactggcttcaagttattcccccacctggaacttccagagttcaggaattataggtgtgagccgctgcacccagcccttccagccctttcacatcctcttgaataattttcatccaccttcatttcatttttgttaaaaaatcctactttttaatctatttaagatcttatctgatgatatgttgtgtttatttgccctgtgtttcttctagcttagtcttcaattttgaaatgattattttcctttacttttattttgttttattttttgagatggagtctcactccatcgcccaggctggagtgcagtggtgcgatcttggctcactgcaaactccgcctcccaggttcaagtgattctcctgcctcagcctcccaagtagctgggattacaggcacatgccaccatgcctggctaattttgtattgttattagagatggggttgcaccatgttggccaggctggtctcgaacccctgacctcaagtgatccacccaccttgacctcccaaagtgctgggattacaagcatgagccactgcgcccagccttcttttacttttaattcttctgtgagttttgtcatccaatttctgagttgtttatattgacttttaatatattcttctacattgattactttttttatatcatgtaactttttaaatatacttcagctagttttgaaatattaggttgtagttttcatctattttgtggatatatcgttctgttatgttttaattctgtaagagtattattctgtggctcatttttattttattctttaattttaaacattttttattttaaaaataattgtcactttgggaggctgaggcagacagatcacaaggtcaggagttcaagaccagcttggccaacatagcaaaaccccgtctctactaaaaatacaaaaaaattagccaggcttggtggcgggtgcctgtaatcccagctacttgggtggctgaggcaaggagaatcgcttgaacctggaggcagaagttgcagtgagccaagatcacgcctctgcactccagcccgggcaacagtgtgagactccatctcaaaaaaaaaaaaaattattatttttgtagaggtggggtttcaccatattgcccaggctggtctcaaattcctgggctcaagcaatcctcctgccttggcctcccaaagtgctgggattataggcgtgaacaaccacacttggcttctgttgttcatttttgtatgaaatcagtttcctgaacttttagaaggaggcttgattgagacaagttgtttctttccctaattttatggctgtagagctccatcctctaatgaattacattctgaaatctcctggccctttctgtctacctttctgctttgatctaggctttcttttttgtcgctcttgtccctgtcctgactaatttgtaatccagtttcaccagtttctcctcagagtgcagctttgccctggaagggattaaggattagttttgagtttctggaggcccaggctgctttcagtctagaccacggactccttgcactcaatcactgtttgaaaatgcaaacccttccctttatcagttgttcataaatttgcttgctgaagttgagttattttacagttctcagatctataggatgccatgttgagtccgtttatatactcttccacagcttataccattttggtcctgtaactatctctaatttgtccacattcactcttactttgaggttcatgggggaaatgttttcatcttgttttgttgtagatttcatcttgtgttggtagattttggatttactttcctattgggggaaccagcccccaatatttcaacgtaagttcttttctattttccctaagtgtcagccggtctgataaataaagggaaagagtacaaaagagagaaattttaaagctggatgtctgggggagacatcacatgtcagcaggttccatgatgccccctaagccgtaaaaccagcaagtttttattagcaattttcaaaggggagggagtgtacgaatagggtgtgggtcacagagatcacatgcttcaagggcaacaaaatatcacaaggcaaatgggcagggcaaggtcacaaggccagggcgaaactagaatttcgcctggttcctggtcctgctgtgcatgcattgtcattgataaacatcaggaaacagggtttgagagcagacaaccattctgactaaaatttactaggcagaaatttcctaatcctaataagcctgagggtgctgcaggagactagggcgtgtttcatctctatctatgactgcataaggcagacactcctagagcagccattttagaggcctcctcctgggaatgcattcttttcccagggctgttaattgctaatattccttactggggaaataattcagtgatatttctcgtacctgtttttggcaataagagaaatatgactgtcctgcccggctccaggcagtcagacctaatggttatctcccttgttccctgaacattgctgttatccttttcttttttcaaggtgcccagatttcatattgttcaaacacacatgctttatgaacaatttgtgcagttaatgcaatcatcacaggggcctgaggcgacatacatcctcagtttatgaagatgacgggattaagagattaaagtaaagataggcataggaagttataagagtattgattggggaagtgataaatgtctatgaaatcttcacaatttatgttcagagattgcagtaaagagaggcgtaagaaattataaaagtattaatttggagaactaataaatgtccatgaaatcttcacaatttatattcttctgtcatgacttcagcaggtccctccgttcggggtccctgacttcacgcaacactttcctatttatatttccaacttgtgtttttttatggtgatatttgggaatattcaaaaacgatgctgctaccaccatcttcttcgcagaatttttctgcaaactatagaccaaggggcaaattctgcctgccacttgtttttgtacagtctttaacctaagaatggtttttgtgcttctaaatagttgggaaaaaaatgtaagaatactatttcatggcacatgaaattaagatttcagtgtcatacagtttcgttggccaggcccattcatttatatattgtctgtggctgctttcatgctacaacagcagagttgttttataggcacagagactatatggcccccgaagctgaaaatacttcttatctagccattttcaggaaaagttagtcaaccctggtcccctataatatagtttttagtggctaaataatattccattgtgtgcacatattataatgtacttaacaaaattcctattggcatttggatgaatcctaaatttcattgtataggcatcatttcacagctaagtataagcatatgtattaatattttattactgtcttaggataaattgttacaagccaaattgcatgatcaagggggagggtatatgtattttaaactctttgactgatacaggctgagtattcctaatctgaaaatctaaaatccgaaatgctcccaaatctgaaactttctaacatgacgttcaaaggaaatgttcattgcaacatttggaatttcagatttttgcgttagtgatgctcagctggtaagtatatagtgcaaatattccaaaagctgaaacacttctggtcccaagcattttgcataagggatattctacctgtattgacaaattgtcatccagaaaggttgtacaaattaaattcccattaaggaaactggctaaataagttatggtgcattcatgcaatgaaatattatgtagaggttaaaatgaggtagatcacttttactgatgtataaaaatataacatacactgttaggtgaaacacccaggttacatatggagagtatgattcctttgtgttaaggaaactggggcattaaaatgcacaaacaaattttttcataagaagcatagattacaactaagttgtgccagttcatatacctaccagcagtatgttcgactggttgtttgaccatacttttgccaatatgatattacctaattttaaaattcttgccaagttaatagatgagaaaagagcgtcttaattttacagtcaggttttgtactttttcccaagtttattggcttgaattaattcttttgtgaaattcttgttccacgtccatttttccttgttgtattcatcttttggtggtttgtaaagctctttacgtattagatattaaccctctggcttcttatccatgttttcctttgtattgtatttagggtgattaatgatgtacaaaaggtttttccttttttatgcagtcaaatcttcctgtatttttaggtgtaaagagccctttccaccttagatttatatagttgttcctctacatatttttctagtacttatttgattttttttaacattgagatctttaatccatcagggatttattcatgtaggctatgaggtagggtttagcattgttttcaaatgcttatattacccacttgtcttagtgtcatttattaaataagccattttttcaaggttatataattttttcaaattgtttttattagaaatctatacatttcacatgttttaaaatcaagtttgaggtgtaatttacaataaaatttactcttttttgagtgttcagttagaagaatgttagcaaatatatgcaattttgtaaccactgctccattaaaaatatagaatatttccatcatctcctaaaagttatcttgtagtcctttgcagtcaaccccctctgttaatcgccttgcaaacactgatcagttttctgtccctaaagtcttacaagatgtcctataaatgaaatcacacagtacatagctttttgagtttggcttcttttactcagcataatgtgtttaagagacatccacactgtggtgtgtgtcagtagttcatttccttttattgctgagcagtattctataatatggttgtaaccacagtttatttaaccattcacttgttcaaggacatcagagttgtatctagtttttaatctattattagtgaaaatgctataaacattcatgtagaagtctttgtgtgacatgttttcatttctcttgggtaaatacctgggagtgggatttctgggtcatgtggtaagtgtatgtgttattttataaccaagtgtcagactgttttccataatgattgcactatcttatttttaccaacaatacatagagatctagtttctctgcgttcttatgagcgcttggaattgtcggtatttttaattttagccattctagtaggtgtgtcagggttatataatttgtttagaataatttgcatattttgagcagtgtttcccaactcatcccctcatctcttaacttgcccagtccatcttcagttgcacaacctgaggcagctcttgtttctgtttttcttctttccatttcttttctaagaacatctgtgcagaaaacgagcttagacataacctaatgcagggtttggtagacttttttctgtaaagggccagataataaatgattttgtttttgcaagccattcagtctctgtcacaactcaactctgccattataacatgaatgcaggtgaaggcaatatgaaacaaagaccagcattcagccggatttgacctgtggaccatagtttgctgacccctggtttagtataacaactttattttacagatgagaggaccgagctcatgtttcaccctttcctctgatttacaagtaaaagtaaaaaaaaggcaaggaccaggatattggcttttaccataagagacatgcttgaattgggttcaagataagtgtgctttatgtgtaatttcctgttctagcaaatgatgttagatgaagctcttaatatagggtctttcggcaatttcgattgcagtaagactttaggaacatcttatgttttaccattcatctcaatgctacttgactttttgaacctattatgtctctggagcaatgagcattaagaaaataaaggtaataaaggtctcagcaaaacagttggagtaagaacggcatgacatccttttattcttcttaatagattttatttccagtggtggaaatgtccaaatttgtttatttctggagatagtcattgtacatcatgtaactatctcatgattcccacctccatttaatattaattcctgattgttctgtttcattaatcattcagatagataaagattcttaggtcaaaaaaaaaaaaaaaacaggaaatcatacccctacggttccatccacacaaacctaaaaataagcattggcactaagtactcagggaaagaacactgtttagatatgtcattgtgtatgtgtttttttcctcccttctagcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaa

SEQ ID NO: 3651 - DNA, 3178 bp, human
gaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagca

SEQ ID NO: 3652 - DNA, 43365 bp, human
ttaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtt

SEQ ID NO: 3653 - DNA, 43737 bp, human
ttaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttag

SEQ ID NO: 3654 - DNA, 42625 bp, human
tgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaa

SEQ ID NO: 3655 - DNA, 43179 bp, human
cgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtg

SEQ ID NO: 3656 - DNA, 41652 bp, human
tcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagttt

SEQ ID NO: 3657 - DNA, 41651 bp, human
tcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtt

SEQ ID NO: 3658 - DNA, 48307 bp, human
ttaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggtttcaccatgttggtcaggctggtcttgaactcctgacatcatgatccacccacctcggcctcccaaagtgctgggattacaggcatgagtcactgcacccggcccaaaacaaactctaaagcaacagcagttaaaagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctcagcctccccgagtagctgggactacaggcgcccgccaccacgcctggctaattttttgtatttttagtagagacggggtttcaccgtgttaaccaggatgatctggatctcctgacctcatgatccacccgcctcggcctcccaaagtgctgggattacaggcgtgagccaccacgcccggcctaatttttgtatttttagtagaaatggggtttcaccatattggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccaccgcgcccggctaattttttgtatttttagtagagatggggtttcgtcgtgttagccaggatggtctcgatctcctgacctcgtgatccacccgctggcctcccaaagtgctgggattacaggcgtgagccactgtgcccggccctggggcagaatatatttctaatgtgaatgttttctaattggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttagaccatttccgtatctatccaaatggatgcttaaaagaagttcagaatgatgctaagatcatctgtcttcagagtccacttttttttttcagtttgaactaaacaatataaaatacttaagggatttggcctagattatggtatatgccaaggtaaagtaaaataattcattttctgtgtgtaatacagaacaaagctgaaagaattatttttattataggcatttacttcagcaatctaattgtacgtgtatctaatttttccccagtgcagttaggaatcggattttgggcaggatcataattaactcttcagaggaaatggtgttcagtttagcacatcacagtcatgcccaactagcctccataacccacctctccccggggttctgaggatcaagacctggacagaaacacttgataaggactttttattattaaaatgtaaataagacaaatagagtagaaccctataaaaatctttttaaaggaaccagatggccgggcacggtggctcacgcctgtaatcccagcactttgggaggccgaggcaggcggatcacttgaggtcaggagttcgagagcagcctaactaacatgatgaaaccctgtctctactaaaaatggatacaaaattagccaggcttggtggtgtatgcctgtaatcccagctacttgggaggctgaggcaggagaatcacatgaacctgggagatggaggttgcagtgagccgagattgcaccactgcactccagcctgggcaacgagcaaacctgcgtctcaaaaaaaaaaaaaaaaaaaaaaaaagggaaccagataatctattattttacctaagtactgcctttgcttctagttgcatgggtgaaatatttcaatgtatggggagaatatagggtgaggagtaagagtaagccctgatttagcttgcttagtgctagtttgagtccttcagtggcaggacagcctgtaaagtaccacaagtatgggagtgttataatggcagagtgaaacgattagagcagggaggaagtgaattgtgccattagtaccttcatgcaaattataccatgtgattttggacagtgaatgatttttgcatcattcattcacagcccatcactctgttaaggtgagagtgtaattcttacttctcccatcaccacctgtagctagaaacaggaaagggagaatgagatgatccagacaacataaaaaagatgcatgtaagcagaaaccagatggtcttttctgcactcacttaatggacattatgttgccagagtgttgtgtttatcagatttgatgtttggagctagtctgggcaggtgaagaacagaaataggcggaagtataggcattatttctgcgcaagcaaactccacaaagctcagggagcagaaaagactccccctcccacctggttcccagaccatgtggtcataacacaatcctaatagtttctggttatctagtgtaaatgcaacaaagaaaaaggccctaagcttctctacttattagatatattatttttggcaattgatttaacttttgccaaccctcagttttctaatctatgaaatgatagtgataagttctgcatatagggttgttacgaaaattaaatgagataatgtgtaaatcaattagcacagtgtctcacacctagaatgcactcaagaaataatagctactattagattagtcatagttatagaatatcatcaagggcctacatttgtataaaacactgcctttacacacaatatccacttgaaacccctttaaacttagttgggggaatacataccactgatttttggacccataatttgatgatttacagataattcttttgggaattaaatgtgtgtgaaagtgaaataactggagaacaaatgagggtcagagatagggatcaatcctataccagaaatttttttcctgcttcaataagggctagaaggtagtgccctatgtaggtctaggatttctttcttccttccttccttcctttctttttcttttgttccctccctccctccctctctctctctttccctcccttccttccttcctttctttttcctttcctttcctttcctttctttcttttgtgtgtgtgtgtgtgtgtgcgagtctgagtctcactctgtcacccaggctggagtgcagtggctcgatctcagttcactgcaacctccgcctcccaggttcaagtgattcccttgtctcagccccccaagtagctgggattacaggcacgcaccaccacgcctggctaatttttgtagttttagtagagatggggtttcaccatgttggtcaagctagtctcgaactcctgacctcaggtgatccatctgcctgggcctcccaaagtgctgggattacgggcgtgggtgtgagccaccgcacccagcctaggatttctgatagaatggaagccttaagttctagctccattagaataaccaacttttcactccctgttctccaaaatgtattgagaaccttacccatcccagatgatgagagtttacaatctgtgacttctgttcttagttgatagtatttctttatgttgcccaaagtaacagattcaacaaaaaatgtactgagatccccatgtaccaggtactgagccaagtgatctcacatacctgagctcattacatcatttatttctcataccaaccctgcgagagcagttattatccccatattatgaatgagaaaactgagcctccactatgttaaatattttgtctagttgcaaggcaggatgcaaggctaagctttggctttctttgggatgtaccttaacgaggtaatcaattggtcttgaacatttttacactgggaaattggttttgctgcacagcttgggaatgaagggtatacagaagaaagacataaggctaaatctaggccagaaaaataagacttcccccacagtagatagtgccacttatttagttagtttttctgtctatcatgactgacccagtctttgcctagtaggttatattttgtatgtatgtatgtatgtatgtatgtctttgtgtgtgtatgtgtgtgtgtgtatgtgtgtgtgtatatatatatatatatatatatatatatatatatatatatacactaggtagcaagcagacatcatatctttctgctttgtactgtactactgctgctagcaaataaccagcaaaatgtagaaaatgaaaaaccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaaacatgctaagttaacctccagagagaagtgcctgtaatctctgttcctggtgtcactttaaagcttttgcttcatgactgtagctgttgtttaaaatgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctca

SEQ ID NO: 3659 - DNA, 10813 bp, human
ggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgatgattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggtaaggcttttatctctccagatggcaagcagatatcaagtggaaacaactggaaagcaaagccttgaatgggcattaaagtctattctagtcttttactgaattgtggctttgatagggctggtttatgagtttgggagcaaaatagtgccccattctagatttaatagatttggaggtagttaattttgagccttccctttcctaatgggatccccctctggacatccatctacattccatagtagacacatgaccatttccccattccctcttcctcaccctctgcacaccttacatttggatggaattttatgcttttctcaaaatacttttacatgtattaagcccctccctaacaccatgtggatttttaaagccaactcattcgtagagcactatgttcagtctctcagcctgaaatcttaatttgccataaatgtctcttcgctcatctgaaatatctaagaatttagagctaggcgatcttttgggcacgaatgtctcccaaaacctttggaccttcacactccatccttggaaaaatcttttatattcctgtaaccacacttatgtaaccacacacttgtgtgagggactatgaagtaacaaatacttttctaggatttttcaaagatttttcaaagatttttctaggagttagaggaatggcatcaatggcctgagcctctggcatccttgggattttcccagcccacctggcaagcgttgtcctactctgatttgcagatggcaccagggatggacaagggaagggcccacttttaagtacagcttctttactacccaaggaactcctgccttgccaagctatagggagggcccaaaaaaggggggccttctctgtttgatatctgtttattttcctttggcaattaacaagggtcccatttgggatattattgtgggtaagccccaaccaggctcaagaccctgcctgccttgcttcagttctaactcctttcatttctttctcaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgaggtaggacctggggtagccaataaaacactccaaaaaggttgctggaatcactgattaggtttctattgggaactttgccaacatgcagctccccctctctttgggaacattaatcaaggcaggaggactcttcagggaaaaagacttgctttgtatttatacaaacgtgccctgcttttatgctcttaaagggtttgtgcaggccaggtgcggtggctcttgtttataatcccagcactctaggaggccaaggcaggtggattgcttgagctcaggagttcaagaccaacttaggcaacatgctgaaactccatctttactaaaaatacaaaaacacagctgggtgtggtgtcatgtgctgacatcccagctactcaggaagctgaggtgggaggatcacttggagcccaggcatggaggctgtagtgagtcaagatcacgccactacactctagcctgggtgacagagtgagaccctgtctcaaaagtgtgtgtgcgggggtgttgtgcaaagtcatgaacatagagagaatctgcaaaacaaatcctgccctcaatattctaaagcaaggctccacgaaattggttgagaaataaggagtaagtcattttattttatttttaattttttatttccataggtttggggggaacaggtggtatttgtttacatgagtaagttatctggtggtgatttgtgagattttggtgcactgtaacccagttcatagtattttatccctcatccccttcccaccctttccctcagagtccccaaagtccattgtatcattcttatgcctttgcatcctcatagcttaaaaaaatacctaaaggtaatcactggggtaagagttgagtgactatctttacagatattttatacctatcaatatgtatatatatttttataaatggaatcaaacttaaatactgtttttttcatttaacattttatttctgggcacttttctgtatcagtacacaacaagttccctttctgtgtttgatgtttggatttctacatattgatttggtttggtgtggcacctacctgtaagttataaaatgtgatgtggtaaactaggctaactaccacatgtggataagagatgatgggatgatgcctttctcccctcttatcaaacctgcagaaaactgactcaaggaaacataccaaattcatatatcaagagatatgtctaagctcctatacttttaagtgcttactaaatttgttgaaggactgtgcgaggaggtgtttaactctttgctttaaaggtcttttctttttcatcattagtatttacatggggacaggaacatagaggggtaaagcccacctttattaaagctttttttttttttttttttttttttttttgagacaggttctcactctgtcttcctggctggagtgcagtggtgcaatcacagctcactgtagtgtcaacctcccaggctcaaacgatccttccccttcatccccgccatagtagctgcgactataggcactataggtgtgcgccaccatgcccaggtaatttttaaaattttttgtagagatgggtctcactgtgttgcccaggctggtcttgaactcctgggctcaagtgatcctcctgcctgagcctcacaaagtgttgggattataggccactgctctcagcctggttaaagcttttgtcaggagggatacattagtgtatataaactcattaatttagaccaattatgaagaggttaatttgaaaagaataaactgcagaattttggaaagacctacagttatattactttctaatgtgagaaatgcttcaagtcatatgtcagctagttttgaaaagtagaaatcttatggaactcacttcagtgaattgatcagatttgtttgcaactaccatgttctgttagcttgctgttaagtgctggtaaagtgctaaggaaaaggttgttctcaagttaaataattatcttgttaacctgctttcactatttgtaaaattagacagctctttctttctggtctgaaaggtggtaaacttgagccagcttaggttttgtgaacctaaattttaagccaaaaggctcaatgctatttctctccttatctatctctatatttctaatctctttccttttggatactgttaaactcatagtacccaggacagggcttgcactctatggtcctctgaataagcaatctgccattttaatgtcagaacttacaagctttctgttttcatttttgtattaaagggagctggctctgcaaatgaaaaccaacctaaaaagatgttcacttccagtgtccataaacaggagaagacagcacagatgaagccacctaagcctacaaaatcaggtaaaagcatacattctgacctctcaaaaaacagccccgacagaatgttgtaaaacttttgcaatttcaagctcagataatacttgtctcttaccttaagtcagcttaatgatttctcgcgtggctctttaattagatacaaatattagcttattttaggaaaatctaattattttgactaatacaagtccagtgtataactttcagagggtcttccagtcttttgcctcatcaaagaagctgtctaggcacaaaactgtggtcactcactgaaacattcttctggctgggtatgcaagaggaaagtaccaagtcactttccagttcatagcaaagcggtattttctcactttctacatctccaatgaaactgttgaaaataattcactctaaaggcccaatggtattcaattgtttttaattatttagaaggcttgtttaagcttctctgtattctgagcagggatgtgtaagtggtgaggaaatgttgacagctgagaggaatactctgctgggatataatagaatgtgatctcaccagaaagaattgtgtgctagagagaattttttcagcaggagcaggggagtggatgatggatttttattgaaccatctttgtcctctcccttaatcccgctcatgaagaaattagaccaggaattcaggaacccattttctggccatgaaatagcagcagttgacttgctcacagcttttaatggcctcatgggcactatactcctatcaagtgaatcacaactgtcactgtgcatcagaatcacctggtgagctttttaaaaaattacagatggtcctggctccatccttagagattctaattcatttgcttcaggaaacggcatgggctttggtgtttttaaaagagccctaggtgattctaatgtgtagccaggattgagaaccactggttgattctaagtcactaagtcaattgaccataagcaggatgagggagggagtggaattaggaatagggaggtagtctccttggctggggtagttgggttggtacaatattatttatcatcaacttttactgggtgcatctattaagtcatcaatcaattcatttcacatgaaatcgtggattggcaaacacaaataacattaccttatctgaaattttagaaactaagtagatacaatatgtttccctctggtctcagttcaaagatgtaagacaatccagtaataaccacctgaagattggcagttacagccataggtattacctcccaggccttcccatgcccagggccctgtggccatagccaagttgattttacccctttgacatactacccatggcatcacacaggtcctaacttttagaagtctggcaccaaagggagaagagtttagaaagcactagagcagggggatcagaggaaacctgaaaggaggaaacattatatggcattccataaacaacataccccaatatcgctggggttccttattgcttgtgtgttatttgctgtggttccagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagtttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcctgttaagcactgaagaccctattgaaattagagttctacagatgccaaaagctgtactttccatcaggcagatggcaagcttactgccttgatgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataaagcct

SEQ ID NO: 3660 - DNA, 71944 bp, human
atgagggccggctggacgcctcgaggcttctctgcctttcacgcttctctccttcctggccggcacccctacctggctcacctgggccccagggaccgaggggccaggattggaagtcgagcgtattcccaaggctgttgcagttgtctttggttgacttacaaaggcaagaaggagggaagcaccaagggggagcttggcccagctgcagtgactgacctggaaatacctagttattcccggggcttcctgccctgcacaccgcgattccctaccacttggtgcaggggtactttgtggcactcctacagccttgactttgacagagtttgtaagaaatgactcaagtctgagaagggagagctgcacaagggtgatgtttatataacagacagaccagggagagagactggacaaagctatagcttctctatgtgtcaagaaacctagccaacatcatctcaaagtaaagcaccacacaaacctggattttacaaggctcatttcattgattagtaacaccattcaaataactgacagcaataattccgtcaaataatgtggttcaattatatcagaacatgatgttttggcactagtaagcagccagcaagcagctagcatgactgacaataaatgatcttgtagggagataagggagatgggggactggggccaagaagtggaagagagacgagaggaaggccgagagagggatggaaagagagagggaaacatggatgagtagagaagaatcaccttaaattttccgagttgtcttaattttctaaacttattccaagctgtacaatatgcagtctcccagttacttgatggggtattatattcaagcagtatattcttattatgtgtccacagtgttgtttttggatgttgtatgtgcatatgtttacgtattgcaagcaattccaaaaggaagaagatattaaccaaaatagatttagtcatatggttaattagtgggtatgtgagtgtacatgattattgccaattttcaatcatggagtgaacactcttcttttcccttaactattccaacttggaatcacagccagaaacccacctcactcattgcaagtctccaatcactgagcgttgcatgggttcatttggccctgacaattcggcacaaagctagtttctccctctgggagaaacttttcctttcccctcctggagccaagcaagcacagtgtctggcacaagtatttgttgaaagaatcttgttgactgaacgaagatgcacttaaggagcttgccttcttagggggtgaccaggccagtaaacagcagtttgcaagaggtagaggatggggacataagctcagtaggagagaatgtaaatgagagtaggagcacttggaagcgagcacatggaggaactgtcgggtcctcttctttgagctttttcctaggctccaggtgttgtgggagaggaagactgggagggaaatggtgctggctcaaacactcactgctcccccgtaaaccttgggcactctcgcaccctccatccccctaacacccccacctccccccaacacaaggaggtttcataggatcacaacttggccaaatcagcagggttgcactttctcaaggaagcccaataggccttgaaattcaaatttgggcagaaacacaggattggttcacagtctcctctcccacatacaattgcagtctagattttatgtataaatatatacatttctcatcgtggagatgtttgaaatgtctggccagtggtggaaatgggtatgttcagagcagccatccatattcttgtgggccttgactccatgccaagagcctcattggcactttgctctaatcaaatgagtctctagtttaaaaacccagtttgggtttttaaattccaaactagttactgtagatatagatcttgttcaagataactagttattaagttctgttactattttcatagagatagaaggacagcagtttacaggagaattatcaagagattggtgaatacactttttggaagaagggagaaaatagcagtaggcttaaattatgtgataccatattgcacaagtatagaaggagatgaaggcaaagcaaaagaacttttaaaatctgacaagaccctgtaattgtggggtgggtgacaatgtcttcactttaagagtaaacaaagtgggccccagaggtttttagctattctctttgggtcatacagtcagtggcaatacaaagattagactcctgagtaccctgactcccagcacagagctgtctagctcagatagaggaaagattgtcatctgagtagtagaccaaaagcatacattgtgggatactgtggcctctctctgggactgctgcagaggtcaattcagcctaaggcaaaatggtgagctcaggcaactttttgttgttgttgtttttgaacagggtctctcactctgtcacccaggctggagtgcagtggaacaatcatagctccctgcagccttgaactcctgggctcaagtgatcctcctgcctcagcctcccaagtagatgggactacaggtgtctaccaccatggcctggctaattttaaaaaaatctttttatagagacagggtcttgctatgttgcccagactggtctcaaactcctgggctcaagtgatcctctcaccttggcctgggattacgggcatgaaccaccgtgcctagcccagggcaactttgtttttagcaaccccagtctctcctgttacaacccatttccgatttcagtaccccttccaccccaggcgttctgggcctgaactttgcccttctctccaagcctgtcttctccaggcctctggccttctaggccgtggacttcctcttggctaacacattgccatcttgtggcccagggctagctcttagccaactgacctgtgatgataggttagtagacattaatgattaactcctgataatgtgtatttcaacaggacctggatgcttttgtggcactgcagtgattgctggtaatcttggggatctggccaggatagtgggcccctcacatcatgctagtcagcttctcctactccaagaacaggattcaggaaagtgaggctgagagcttctgcaacaggtacttgacacctgaccagggaattactattgtaaattatgtgtcagcctgctccccttggctgcaaaacttccctgatgaccctggaagcagtgtgggttacaatttgagattagaagccacaaatattgacttgtaatgaggtccagttgctggtattctgaggatccatgcattctttcttggccctgagcagccccctggaatccagatgctagaggacagccaaccctgaagtgtcctctaccaacctggacccatcttcccatagcatctgcaaccagttctccggaacccgagaccttgcggcatacctagctgcacggagagaacaatgatgaacatgaaatttggctctatgtcaccttccagttagggaaggcaaatttaggccatttgaaagcaccagaaatgtgtagctgcagcttagcctgccagatcagacccaacttccactcctcactgtaattagacgtgtttaatgtggtcattagagatccctgtggcacttcacttccttctctccctcccttctttcctgttttttttttctttccccctagttttagaagaaagattgttaactctaatttcctggcaaggggctcagtctgggtgtcgcattttgctaacttgcattcactcagttgcacttttcattcatgagagcgataggagaattgatgggtgccaatggagtggcaggtaccagtgtaggggtcagagggaggagatactctcccaggcccccagcctcaccctctgtaaggagttagggggaaactggctcttgggcaatttcttgaataaattatttgccgtatttaccagttcacctaaagttttttctttcagttatttacaacataaagtatttaaatctttgcaaaaattcatttaggagaaaatggttttaaagcttttggagatgtctctaaagatgtagttgacaggtttcatttggtctttagcagcattctaagggatgttccacttgttgtagggaggtttggtttccttgggaatatatgaacaatctggaaaagtatattatttcatcaggagccaaaatttcagcatattatatgggaatgcttaaatttgtttctttaaagaaatttatgtattttcttgattgacaatggaatatttgtgtatatttatggtgtacaacctgatgttttgatatatgtatacattgtggaatgattaaatcaaggtaactaacatacccatcacctcatatacttattttttgtgcactagcttcttttgaatcctttgaaagtgcattttcagttgtgtcaactttagcatttttagaattctttcatcagtttctcatataccataattttttgttgtgtgttatttctggaaattagtaaccaaaatgtaaaatgcgatgtgattgcccttgtcatttcctaatgattttctactttagcattcttttagctttttaaaccaatctgcttcttatgcttccttcacaattccatagttatagtcagtggatagcaaatttgaggaatgaatcctacaatgtattatagtaatccctcttggcatctttactctccttctactgctttaaacggttttactctttcatgaaatcttcaagagctattaaaacagcccattcaattcaaattgctataaactttataattcactagaagaaattagttttagtgaattggcttgctttcagaaggccaagttaagttagtgaaggcttgccatttgattacttcaaatgcatatatagtactgccttgacccagtacttctgagtcaaggtaagtacttgttctcttaacagctggatgtgctcacctcacctgccactcacctcctgctgtgtggcccggttcctaacaggctacagactggtagtggtctgtggcttgggggttgcaggcccctgttgcatgctattacttcaaatgcatgtatagtacttaccttgaccctcaactggagggtggcaggggcatgtgggggataattttgctccccaggggacattgggcaatgtctggagacatttttggttgtcaaaaccggggccaaggtatgctactgacatctagtggttagaggcccagggacgcggctaaacatccaaggatgagcaggaagagccactccctacctcctaccaaagaattttgcagccccaaatgtcaatcatgccgagattatgagactctaccttaaactaataacagtttcccaaagtagaagtctgaggaggacccaccttaagagcgtttagaccagcactgttcactcgaagtttctgtgataatggaaatgacctctatctgtggtgtccaatgagatagccactagccacgtgtggctactgagcccttgcagggtggctagcataactgaagaactgagtatttaattttattttatcgcaagtaatttaaaattaaacaaccacatgtggctagtggctttcctattggattcagtgttagaggcactatggtctagtggagcatagtccttggttcatgtccacagtctaccactttctagctttatggtcttgagtatgtcatctaggccttctgagcctcagttttctcatctgtaaaacaagaagtaacaatggtacctacttttcaggatggtgagtatcaaattaaattatgcatgagaaataaaacatgtagcagtatctagcacagtaagaatttgagagatgttagcaattattgctagagatttgtgataactatagtaattgtcatcatgtaagtggggcttgtgcagggcttaaaaagaagacctcccctggaatactatttaaaggccacttcagaggcagagctccaactctcagccctcacaggattcctctagtcatgtccccatgcctctttggccacatctgtaaagtgggaataataaaatggtaatcatagtagtgcttctcccctagctgtctatgctacagcattgttgggttgtgctctgaagagtacaagtccctctggaagcataaggtttgtgccaaaagtttgcacattacacagctgtgctttcatccagattcagtacaaaagtcctgccttggtaaaactgtcttaaatttggaatgtaagtgtctgaattgggaaggttgtaccagagagcagcaggaaaccgggagttcctcacgatgttaggccctgctctgttggtcacctgaccagtgtatggcaggacagcccaggcaccattttaaggatgcattgaagcttggcatttggggctgggaagccagagcactatatgggcaaacctgcctcccaggctcctaatgaaggagcaagtcatgtggtccaagtggaaagaagagcagcttatagtgtgccatcaaaggccatacttcccaacggttcagccacttaggcagagtgtctggactgacagatacatatgtacacacgtggaaaatattttggtaccatatagtagaaagtgcatggggctttggagtcaaatatgggtttgaatcctcacaatgctacttactagccatgtggccatgggtgaatgccttaacctttctgagccttaattttctcatttgtaaaatggagatgattcctacctcatggtgttgtcacaaagattaaattaggtaactggcaggcacacataggttgccctcagtaaatatgagttcccttgtcaccttatgttgacaaacaaagagtgaccattaaccaattaggtagtcatgatcccatttctgttcttctgggacagccaaaggaaatgaaagtttctgctgttggtataggaaagccatttagtcctttctggagaagaggaaagggggaggattttccttgctgtgccactacagtgtccaaaagagcagtctgaactgtttaagaatagcctcgggtgaaatataaaaagcacagggcctgggtggtcacaaatacagttaaggaggagcctgagcagcctcacctgggcttgatacttgcctcaaagaagtcactccattctgtgaacccagagagaggctttctggggacagctggtttcccaggagtctgggattgaaactcaagccgtatctgtggcctattgatccaatggtggctaatgggccaagggcacaggttggatccagttggctttgccctcacacacccatgggccccagcccccaatgcaggtaaccattggacaaacctgctggttactgggaggctgatggagagagtatgggtaactgcagaaagtctcatcccccacttttgggaaactgatgaagagcagggaacacaggtcattagcaccatggggaggaaaaccttctggtggagaagacagagtaataccaataatagtgaacatgtattgagtgcttactgtgtgttatgcctcatgccaagagctttatatgagtgatatagtttagatacttgtcccctccaagtcccatgtcgaaacctgatccccagtgttgaaggtgaagcctagtgggaggtgtgtgggtcatgggaatggatcccgcatgaatggcttggtgccctaccagtggtaatgagtgagttctcactctattatttcacatgagatctgtttgttaaaaagagcctggcacctcctcccctctctttcctctttttttttttttttttttttttgagatggagtctcactttgctgcccaggctggagtgcagtggcatgatctcggctcactgcaacctctgcctcctgggttcaagtgattctcctgcctcagcctcctgtagctgggattacaggcatgcaccaccacgcccagttaattttgtatttttagtagagatggggtttcaccatgttggccaggctggtcttgaactcctgacctcaggtgattcacccacctcggcctcccaaggtgctgggattacaggtgtgaggcactgtgcccacctccttcctttctttcaccatgtaatctccacaaaccagctccacttctgccatgattagaagcttcctgaggtcctcaccagaagcagatgctggtagtcttgtacaggctgcagaatgataagccgaatcaaagtcttttctttttaaattacccagcctcaattcccttgtagcaattcaaaatggacaaacacagtgagttagttcaccaagctgtctgtgagagcagggcccttctctttattgagcactgctctgggctcttcttagcacatatcaggagctcaatgaacaattattaaatgaatgaatcttcacagttagcctatgatgaaagtactaagccccacttatcagctaaggaaatttaggttttcagcagttcagtgtcttgcccaagatcacacacctagtaattgacaagagctaggattcaaacctagatttgtccagcgtcatagcctaaccctttcacaattatgttatgcttcctactcagaaggtcaatgtgccagatttctctttctgtgacaaaagcatatctgcttagaaactactggatcagagagtcaagagcactacacaaagatgacttatgatgttcatacttctttcattccacctacttccttcatctcctaacttctgtccccagacccttctattatcatgttcattttataaatcaggaaactgaggcatgaagggattatatgacttaccttaggccactcagcttgtcaagatctgcattagtctgaggttctggtcctcaaaaattccccagcctgataggaagagggagagtttcatctaatgaggccaaggccccaggggaaaaaattaacaaagggccccatattgttaaatcaacttgcttgaacttctaaaagtagaaacaaaatattttacccatctaatttgaacattttgaaccatatttcttgctacaaacacaaaaacttagaacaatgtaattcagttatctactataacatataagggagatgttcaaaatgagaaatagaaacaagagaacaggaaaagaagagatatggacctgggaaagtccagatatgagtaagaaaagagcaacagcacaggaggcagtgtatttcagaaaaatattgctacagaaggtcgataaagtcatgttgcatttttacattaacaaggtctttatttcttatttcctggcctgtgaacttcatgagctaagtactaactagcccatcctatgaactaaggatcatggtacttcttccttactgcatttagatcttccctttccataagcccaactgtcctgggaaaatggagagtgaagtaagtcaaagggagagtcttctgagcccatgggagaaaggaaagggtcctgggagcacgggcgcgtctgcctcctcagatttgcactagaacccagtagatcagggaaagcttcctctctagagtttgccatcaagcatattaacaaaggtttctgcattagttcactgttcatttgtgatagttggaggggtatccagaaacctgttaacggaaagaggagggggaatatccccactaaacctccaaaaccctttttaaaaatggggtcttgctgtgttgtccaggctggccttgaactcctgggctcaggtgatcctcttgccttagcatctccagtagctgggactacaggcatgtgccaccatgcccagccatgccctatttttgaaggacataattttaacttcacacgtgaagaatgtttgtttcttttgtccttgtggccccagaagccaaacatcaatgatcctgagacttattttatacagaaatggcttctgtttgcttcttcagagttagaggaaggaggaaactctttgggatgaggtagttctctttagaagtggaggaaataatgagtagggaatttttagttaaatctgcaacctgtgcttttttttttttttttttttttaagaaagagtcttgttctgtcgtcgctcaggctggagtgcagtggcgcaatctcagctcactgcaatctctacctcccgggttcaagcaattctcctgcctcagcctcctgaatagctgggattacagccgcatgccaccacacccggctaagttttgtatttttagtagagatggggtttcaccatgtcggccaggctgatctcgaactcctgacctcagttaatccacctgcctcggcctcccagggtgctgggattacaggtgtgagccaccacacccggcctgtgcattttttaaatgggaaatatagctttggtttctaaacaatctgaaagtaagacagttttctgcaatattgacaggcttctgaaagtcttgctgtgaaggctgggccaccattggcccactcagggagggcttatagtgagcctctgcaaaatctggctactctaggatgaactgggaactttgaaagatcatctcaggaaataatagaatccaagaatgcctgagctaaaaataaccctagacttcaagtctagttcaaccccttactccttaggggagtaaacggaggctccaagaaaggactccatgtgccccaggcctcacagctagttaattgcagagctggggtttgaactgtccaaaaattgctagaggcctcattggagactcacatcttagaggtgtttattagaagaaaaataccttcatctgtggtcacgattctctctagatatcattcaaattgctttttcttcaccacacttgccctgtcctaccatccatttctttttattatttattatttttatagatgtaggaggtacaagtgcagttgtgttacatggatatattgtgggtaactgcagaacatctcatcccctactttagggaaactgatgaagagcagggaacacaggtcattaccaccacggggaggacagccttcttgtgcagaagggagagtaataccaataacagtgaacatgtatcgagtgcttactgtgtgttatgcctcttgccaagagctttatatgagtgatatagtgtggatacttggtgaagtttaggcttctagtgcacccaacacccgaatagtatacattgtacccaataggtaatttctcaccatccactcccctcccaccttcccactttcctgaggctccaatgtctattaatccactctctagctgccatccatttcttatggcttcccaattcaggttttctgtttcagccatgccctgtacccaaggtgatttacagcagggtttccttaaagctaggtatttggagccctcacctcccaggagtcacctggaaggttctggacttgcaggtccctgggccccactccctctgaagaagcagcatccctgtgagtgagtgccaaggaatcagtgatcgttacccatgctcttgacttacagccttcctccttaaaccctgtgctcacagtttgcctttatctgtcatgggagttttgtaaacctcactatttattgagcactttctttgtgccaggcactgtgctactttctatgcatctcatttattcctcacatgctggggtatgcttttctctcatgctcaagtggacaacggggcagtgtccagctgggtcaggggccaaccacctgccacccccatttaggagcttctcccgggcactgtgaggacagatgctactccagtgtggctttttctttttcctaggtcattctgactagggattcttgtgcctgaagtttagagaagcccaacagatttctgctctcctggggttcactgccacttttcttttccttccaggtagtacactctaggaagaagagcctgggcacatcatttactccttcctgctcactagggtttgtggatgtcacctgccctctctgtcctcatctgtaactcatctgtgctgactctcagtgcctcagtgctcaagctgtcagcaaacttttctgcctagcacctggcgtatcttaagttccgccttctcggcctggcgcagtggctcatgcctgtaatcctagcacttttggaggccaaggcggacagatcacctgaggtcaggagttcgagaccagcctggccaacatggggaaaccccgtctctactaaaaatacaaaaattagccgggcatggtggtggtcacctgtaatcccagctactcgggaagctgaggcatgagaattgcttgaacccgggaggcggagtttgcagtgagccaagattgcaccattgcactccagcctgggtgacagagcgagacaccatctcaaaaaaaaaaaaaaaaaaaaaaaaacaaccaaaccaaaccaaacttctgccttctctattgagtctttcatggtgacttcagcctgcatggaaatgtcccttttagtcctttctgctgtagatggagccacccataaaagcaccttctggtcccttctgtagcttgacggcctcctatgttgttccccttcagtttcaccttcccttgttctttgacctcatttacatctaaatctcagcatactagccttgctttgctgttccttgccattctcagctttgccatgtgttatggacacccttttctgacttgatcttacccctctgcctcatttctggcatctagccccctgtaccacacatgtaagcaaagtacactccagctttttgttccacaactcttggggcctgcagactccttccacatgtagccagtgccctagagcaggggtggcccatgttttggcttccctgggccacattggaagaagaattgtcttgggtcacacataaaatacactaactacagctgatgagcttaaaaaaattgtaaaaaaaatctcataatgttttaagaaagttgatgaatttgtgttgggccacattcaaagccatcctgggccgcatgcggcacaggagccatgggttggacaagcttgccctagagtttaaccctgagaatccttgtcctaacacatgataattttgcctcatcttattttacaaatgtgagaactgaggtccaaagaggggctatgactcgggcaaggctgcaaggacaactttttggaacagcagatttcaggacgcgggctttgtaattcctaatgtagttctattctcaattgtttcatgtgtattctttctctttgtcatcagggaattggtcattttctgtagcacttattggctctggagtcagattgcctagattcaaatcctaccttcagaattcgaacttgtcatgtgcccctgggcagttacttagcctttctgtttcctcatctacaaaatgggagagaagtgaaaataactagtacctacctcataggattgttctgaggattaaatgagatgatgtatccgaagcacttcaaacagcatttgcacatattcattgtcaagtaaatgttaacgattttattttgtcattgcctacatagcacctgaaacaggtctaagcacatagtagctgtgcataaagaccttggggttactaatgagacaggctctgggaaataatgttctgactttgctgtctggttcaaggggaaggattctgatggtggatattttaggccaggtagaaagagagggtgatgccatggctggggtaaaaggaaagatttggggctagagaaccttcggataactcttcccacaactccaggtagggagctgcctctgctgagctgcagggctgtacatgggatcagggttaaagaaatctgaggtcctaaattctcagatgtcaccttgactgagaatgtccagtgatctcagattcttggaggcgttatttcttttctaaaatatttttagaaattttctaaagtttcagaaatttttttttgtagagatggggtcttgccatgttgcccaggctgctcttgaactcctgggctcaagtgatcctctggcctcagcctcccaaagtgctgggattgcaggcatgagccactgcacctggccatggcattgttatttctgtgggtatgtgccctctggggacaaagacatcagcatcacccctccttatgcccattcccttcctgctaagatgaaattcactcagagacttctatatccctccagaactgggagaccaaaaggctatttctcataaccatggggtgatgctgagattgctttccccaacctccaccctgtgggccaaaaggctgcaagatgaaaccagaaagttacaatgtgcctgcacaaaggacacagatagttcagcttgggctggggacacattgcagaggactggttgttctttctcccttatctcccctacctcccctggccagaaaatgactcctggtgtctccactccttgacggcttttgaattctaagagcaggagatatctatatcaaatcccacagaatccaatgagctatgtaaaattcacatcctccactagcaaccccctttcttctactttttttttgtttgtttgttttagatggaatcttgctctgtcaccaggttggagtgcagtggcgcaatctcggctcattgcaacctctgcctcccaggttcaagctattctctgcctcagcctcccgagtagctgggattacagtcacccgccaccataaccagctaatttttgtatttttagtagagacggggtttcaacatgttggccaggatggtttcaatctcttgacctcaggtgatccgcccgcctcggcctcccaaagtgctgggattacaggcgtgagccactgcacctggccttcttctacttttacttttttttcctctttggagatttttacctcctccctcaactggtgttattattgaccactggaagcagtaataacagctactgcagtaactcaacaacaagatcaaaagccttagacacattctgctgggatgggcttgagaactagcagagcatttgggggcagagctcttggcacccaacacacactcaaagctgtgaagtccatccttagggcccctcaattctgacttttctcttgagtctcccagtgttctcatgctttcctgcccctcctccccaatgctggaacagcacttcagtctgaccacccaagggtccccatgctgcagacctatctcccttaagatccctcatcacaatatatgtatctagtgggtcatttttggcaggactctgtgcattgttaaaatgtcagcaaatatctgcaaaggtgttgggggctgctaatggcctggtgaactattctattttcgggtcatgtaatagaccagtaaggaagattctctagggcagcagtgagtgggcatttcaaattgaccagattttgccaagtgaggaaggagaagagtgtagtggtcgaatcatgggctttaaaatccagaactgggtttgagtcctaactctattactcacaacgtgtatgaccttgcacagactgcctaatttcagcaagactcagtttcctcatctgggaagtgggtgtgaaaagaataaaaacaaaataacaatgcctactacatagaactcttgtgaggactcaattagataatgcacataaaataatttttcacagtgcctgcctggcacagactgaggactcagcaatttcattagttggattaattgcataatattaattgcccctcactgcacaagaacagagcctttgatcacaggatttgtggattgtaagatggaataggactccctgtctgctaggcttctaggccactagagagatctcagaaaggaccttttaggccaagttctttgcatgttcactggatgacaatcagggtgctcagaggtatttctgaaatgggcttcctcgtgatggcgaggtggagagggtggattccattattctttggccttctagtgtgtaagaaaggcctcagtgacaattgtcctgcagcaagtatctgaggcaggcatcccctagagcctatttgggcatctgtttgatgatccagatgttcaaatacccacaggtgagggtgtggaatgtagaaagatgatcttctctccctggtatgtcttgctgctgacatccatggacatttggagggttgactttgccgaatttgctgaagatgtcattttaagtagtgtgccatcgcagtagtgaagatgtgaaattaatctaactgtccatcaatagatgaatggataaaggaaatgcagtatatatacacaatggagtactacttggctatgtaaaagaattaaatcctgtcattcacagcaatgtgaatgagcctggaggatgttatgttaagtgaaataaggcaggcacagaaaggcaaataatacatgttctcattcatatgtggaagatgaaaaagttgatctcatggcggtagagagtagaatgatagttaccagagactgggaagggtgtatgggtggcaggggtgaatgaagagaggttggttaatacaaacatacagttagatagaaagaatcagttctaatgttccatagcagagtagaatgactataattaataatatattgtatatttcaaaatagccacaaaagaggtcttgaaatgttcccaacacaaatatttgaggtgatgaatatctactaaataccgacttgatgattatatgttctatgcatgtaacaaagtatgacatgtaccccataaatatgtacaaacataatgtatcaatacaaaatttccaaattaaaaaatataataatgtgccaccaaagccatgcatcagtttctgctttgggtagatacccacccagggctctcagagccagcataaatggccatcaagattgttctcctccaccactgcactccagcctggcgacagagcgagacacagtatttaaaaaaaaaaaaaaagaaagaaaagaaaaagaaaaaaagattgttctcctcctctacccaggttcccgtgagggtgctcacacctgctcctaggagcacaaacaaacagaagttcaaggctagctagctggccctgggcttgctgagaaatgctgctgctcttggcccctgctgggcaaatgccaatcattccgtctatatcccacagccctgatttgtgcatggacgtagttgtatcctgggtggaacctggtatcaaacccctaccccaccaaatgaactctgccaatcagtggggtgactttccacaatggaatcatactgactactggtggactcgtggagtaggacttctggagctcattgtgtgatctgaagggcagccatcttcattacggagtgtccaagggctgcatttcaggagctggctggacctctgatgccctcctgccaacctcctgcaagaaaagaggaagctgtggggtgattatagcctcctttcccctggaggatactttattttgcaattaaggggtataggggccctttctgatactttcattttgggtggttcctcgttcctcaatgagttggcgtcctggcatcagacgctccctctagaagaatccaatcaccaccactctctccccttaccacacctcagaatgttcaactccagggctctttagccactgcttggtggatgcacatactcttggttgagggcacaaagtacagcaatagtttgaaaggctgggtgcagtggctcatgcctgtaatcccagcactttgggaggcagaggcaggagggttgcttgagcccagtagtttgagaccagcctgggcaacatagcaagacccccccaacaagaaaagttttttaaaaaattagctgggtatggtggcacatgcctgtaagtcctagctactcaagaggctcaggcaggaggcttgcttgagctcaggagttcaaggttacagtgaactatgattatgccattccactctagcctgggcaacagagtgaaaccctgtctcaaataaaatagtttgaaaggggttaaagacattgtcctgagggtagggaaagccatctcaaacaagctgagcctttaaggggattttgcatgttctaacattttggcagggtctaatcagtccagctgacaatttgcttgagagagtagcaacttaagttcttcgtaaagaagtgcttgcagtggggtgtgctgggggaagggagcatataatcccctcgtgtgcttctataccaggtctgtgttgcagcttacatggctccaaacctaccccagttttggcttcatctgcaattagagctagagcctctaggactctattagtcttctattgctatgttacaaatgacaaaaaaaatactgtcttatgacaacacaaatataccatctctcagtttctatgagtcaagagtccagactgggcttagctgagtcctctgctcagggtctcacaaggctcaatcgccgtcagggctgaggtctcctctgaggtacagggttatcttttaaactgaatggttgttggcagaattcagttttttgaggctatagggctgaggttcctgatttccttttgttccccctctgaggcagggtctcactctgtcacccaggctagagtggagcaatcacagctcactgcagcctcaacctcatgggcgcaatcaatcctcccacctcagccttaactgggactacaggtgtgcaccaccatgcctggctacgttttgtatttttagtagagacgggtcttcctgtgttgcccaggctggtatcaaactcctgagctcaagtgatcctttgcctcggcctcccaaagtgctgggattataggcgtgagccactgtgccctgcctgaggtccctggtttcttgatggctgttagctaaggggttctctcagctactagaggccacatgtcatgtcctgccatgccctgccatgtggccctcgacaacatggcagttggttactccaaggccaacaggacagcatctgctgcagctttgatctctctggcttctattatctgatctctaaatcctccttttatttactcatgttcaaatgtgtgttttgtttattttttcaacttttattttaggttcgggggtacatgggtaggtttgttacatgggtaaattgcatgttactgaggttttgggtatgattgatcccatcacccaggaagtgagcatagtaccctataggtagtttttcaacgctgctccctcccatcctctcccctctagtagtccccagtgcccagtgtctgtcgttcccatctttatgtccatgcgcacgcaatgtttagctcccacgtataagtgagagcatgtaaaccctccttttcagaggcccacctgattaggttaggtccacccacactgaaggagaggggatttacaggacatgcataccagggggtgggaatcttgtgggtcatcttagaattctgtttaccgcagactctgtgaaatacatttcatcctattacattgtttaaagaaaaccaacaacatgaggccagctgctttccattagcattctccattccgggagggcaacagagctgtcaggaaaagtcttctgaatccctgaagccaaatcaggctgtggtttaaaaaaattcaacaaccttggaagaagggccttttccccttttttcccctctttttcccccaaaacccttgttcaaccctcaaatgagccagtttcagaaggaaaaggcagctctggggcctaagcatctggggttggcctagagaagcaaacaaagcactttaataatgacttgataacgagactcgatacctctgctctgccaggtttcctgataaccattattacatgactatgtttggtccttggaagtggttccgaaagcctctcataatttactggataaaaacatatagttcctcttccctcattcggtttgccagctttttcatgggacttcatgcagaagggtcttttactgaaagtgtgtctcaatgtgtccccatatgtttaaaaaagaccacttttcccactgatttctgtttgccactgcaagaccctctccaccccctgcattcatccatccacaaaaatatatagtgagcacgtcctgcgtgcctggtattgtgctaggtgctggtaatactcagataatcaaaacatggtcactgttctcaaggtgatatcaactatgacaacaggtatgcgcaaaggtctgagagcatggggcatgggtggccggtacctttgagctgggtcttgaagcatatgtgtaatttcaaggatgtgggaattagagagacgatgttccaagccaagtgcacaacctgtgtggaacacagagaaaacaaaagaacatggtgattctgggaggtcagagcatggggctgtgagtcaggggtgggctgctgggagactggaccccctccagtgggcagagaacaccagattgcagagggccttgagtgttaagaacttggcttttatcttgcaggcagcaggaagctggtggacaagtttaagcggggaggctcatggttatatttcagagagaacactgtgccttttttgagattgtgaggtgactgtagctttttctaaatatcataaataaacgtatagctcagaggaggcagccccaaggtcactaccaatgaatcatggtatgattaagggacaaatttattttaaatttttattagccataatgaggcacgtgaaagaaatatacagtgatgcctctaaaaggagacacttgggaaggaaattatttaataagatcagcttgtgggggaaaaaggacagaaaaggtggtggctggaaagtaggaagaggcagcgtttcttttattgaaacatctttctccatgagggtccagacctagcccagctgaatggggctccacactcacggttcacgtggctaggatatctaggaatgggatctgtgtatcaagggaaagaggggtccaagagtgcttgattctgtacaggtgaataacccagggctgggagggaagacaggtcttgctaaactggaaaacaagggggttcttctgctaggacaagtcttcctctgccccgtatagcatgcctctgtgtctgaagaaatttctgaccacaaaggtggttctttgataggaaccactttttattttaataatatattttacttaacccaatataaccaccatattatgactatttcaacatataatcactataaaaataatattaatgatatattttacattatttttgttcacactaagctgccacatcagctgcatcagccccctgctccaaaccccccagtgacttgccatcaagctcagagtgaaatccacaaaggtggattttattgaatttttcaataaaaaattgaagaattttttttcttttattgaatttatgcattcattcaacaaacgtttattgagtgcctgctattcccctgacacaccacatctgatccaacagtaaatcttttgcctctttcattctaggcactattctgggtcctgggagattcaatgatgatcaaaatagacaaggcccctgaccttatggaatttacattctagttgaggagatagacaaaaaactagtaattaacatagaatataattttaggcagcagtgagggctatgaagatgttaataaagaataattggcctggcacagtggctcacgccagtaatcccagcactttggggggccgaggtgggcagatcacctgaggtcgggagtttgagaccagcctgaccaacatggagaaaccccgtctctactaaaaatacacaattagcagggagtggtgtgtcacgtctgtaatcccagctacttgggaggctgaggcaggagagttacttgaacccgggtggcggaggttgcagtgagccaagattgcgccattgcactccagcctgggcataaagagtgaaactccatctcaaaaaataaatgaaaaataaaaaataaataaaaaaagaataatgggatggagagagagtgggagcattttaactaggatgatcatggacgtgctctctgggggaagtaacattggatgcttgaatgatgcaagaaagccagccatgcaactatgtggggaaagagtcctccaggcagagaaagcagcaaatgcaaagatcctgagattgaaagggggcattaccaggagggccagtgaggctaggtgaagggatgaagtaggggggtagcgggtttggtgatcagtggagcatgggggtgggcttgcatcacataaggcccatggtaaggggctgggattttactctcagcttgatgggaagccactggggatttggagcaggaggctgatgcagctgatgtggcagcttactgtgaacaaaaataatgtaaaatatactattaatattatttttgtagtgactatatgttgaaataatcataatatggtggttatattgggttaaataaaatatattattaaaagcagtctcacctgtttcttttttcttgttaaaaatgtagctactagaaaattgaaaatacgtggcttgcaattctgctcaggttaacttttctatttaatggtgaggttctaggaagtgattgtagacaaagaagagagccaaggacagagccctgcagtgctacatttcaaaatcagggagaggagagagatccagcaaaggcgacccagaaggaacagccaataaggtaggaggaaaattaagggagtgtggtgttccagaagacaagtgataaaattattcaaaaagaagggcgtggccaatcacgtcagatgctgctgaaagttaaaggaactggtggattcagcaagcgcagtgttggtggactggcttggaagcagttcagtttggaagcctgattggagagctcacgagaatagaaagtgaggacataaaggcagtaagtatagataactctttaaagaattttactttaaagagatgcagaggaatgggatggtaacaggaagagaatttgaactcaaggggagatttgtgttttgctgtagttgctgggttgtttaggagaggagacagttccacatgtccagctggattggttgatggtggtgttgtcaacagagtgcctgctaaaagcctcagggcttttaggatttggttagggaaataaggcaagtatgctacaaagaatttcagacaggacagtctaagctcaagggttaaatgcaatgattctattagtgctctaaaagttcagatgtagccaagatgccctctttctttgttctccctcatctttcatatttttctctttagtgttttttttttccctttctatcttctacacttgacagtggtaggtcaatgacaatgttagcctaccatggccccacattgtggttaacgggctttttttcccacaggcttctctaagatagtttatttccccaatgtctaaaaaggcttctaaagtggcaggggtgggggtgctgctgtgtttattaagatggccaggaacttaccaatgacacaaactcctcctgttctccctctgaatttcctaagagcttttgaatatttttttttttttttgagacaggttctcaccctgtcaccctggctggagtgcagtggcatgatcttggctcactgtaccctcgacctcccaggctcaagtgatcctctcacctcagcttcctgagtagctgggactacaggcatgcaccaccacattcagctaatttgttttgtattttttctagagatggggttttgccatgttgcccaggctggtctcaaagccctgggctcaagcaatccacccaccttggccttccaaattgttgggattacaggtgtgagccactgtgtccagtcagatgttgaattttccttcctctttgctcctgccagatctccagatcttggaaaactagcagagacaggaatgccaagggtaaagccattcattctgggacaatgcattggtgtgtaaatccattgatgtgggctctcctgatggtctgcatatgataagaaaggcggtatggttattggagtggagagggtgtgtgtgtgcatgtgtctccatgtgtgtgtgagcggggtaattattgatcactgtgtgggcctgggactcaagtcatctttaggcagaattgtaatattaactcataaaagttgagtgacttaaaatatcaatacctttcagccaggaacatacctgtcgttgaacaaattgggtttattacctgtggcagtgagggggaattgtggggaaccacagggcatctcagtaagtgggtctgaagcaatcttgacaccacagccctgtcagttctcatggtgatttggaaccttttgcactccaaggcttcagtcactctggctatgtgaactctcaagttctccttagccttagagcctgtggtcaccagccccgccccccggccccccacctctggagatacatcaggggtttacagctagaaagcaggacaggatgggcctgaagcccacccatgaaacagcaatggcagcatagctatgtctgggaaaagagcagatctggagtggcaaggggattccagaatctacttaaccccactttacaatagttcattcagttacatcaagacctcaaggagagttatcataggcacaaagtctctgcttgcctttctatggccttctggcacagatgactatagcaccctttctctgggttgtggtgctcctcagatctccctcccaccccacccccaccccccacacaaactttcatcaagaatgaaagcattgggacaggcacagtggctcatgcctgtaatcccagcactttgggaggccaaggcaggggaatcacttgagttcaagactagcctgggcacagagtgagaccccatctctccaaaaaaaaaaaaaaaaaaatatatatatatatatatatatgtattagctgggcatggtggagcacgcctgtactcccagctgctatgaaggctgaggtgggaggatctcttcagccaaggaggttgaggctgcagtgaactatgattgcaccactgcactccagcctgggcaacagagcaaggcgctgtctctaaaaataatgtcagcattgatttctaaaagtttgattatcaaccgacatgcttccttagaagcatgacatggagtgagtcatgggagaactatccttttcatgatcactttggttgtttcccgtttttaactattggaaacaatgctgtgatacacattcttgtatgtatattattgtgtgcaagtgtgactatttatctataaggtaatgttcgagaagtgatgttcctggatcaaaaggtatgtgcattttaaattttgataggtattgccaaattgctctttagagagttagaactactcactccagagtgcatgagagtccctattttttcccaccttcgtcagcaatgtaatatcatccaaattaaggattttgacaatctgatagatgacaatacttatttgatatgtttatttctatctctttaattgtcagtgggatggagcctcttcatatgtgattatttgtatttctttttctgctaactgctttgtagtctttgtcccttttagaccaagttgtttgtcttttattgatttatatgagctctttataaattaagaaatttggcccctgtatctgttatatttgttgctagtattgttttctagtttgtcattcttttattgacttatttcttctccataagtttcacttttttttttttttgagacagggtcctgctctgtcactcaggctacagtgcagtggcatgatcatggctgactacggcctcaatctcctgggttcaagtgatcctcccgcctcagcctccctagtagctgggactacaggcacatgccacaatgcccagctattaaaaaaaatttttgtagagatgaggttttgccatattgcccagcctcaactcaaaactcctgggctcaagtgatcctcctgcctttgcctcccaaagtgctgggattacaggcttgagccactgtacccggcctgaaattttcatgtagtcagatgtttcagtcttttctttatggctctgtgtgtttatcaaaacaattttgtctccctgggcacacccgtgaatagtaataggcatccagagttaatgggccccaacccacaaaacaatagatcaggttttttgcatttgtctttttttggtaacagctttattgagctataattcacatactatacaagtcacctatttaaagtatacaattcaatggttttaaatacagtcacagatttgtgcaaccatcaccacgatcaattttagaacattttcatcatctcaaaaagaaaccttatctgggcacagtggctcatgcctgtaatcccaggactttgggacgccaaggcaggagaattgcttgagctcaggagttctagttcaacatagcaagaccctgtccgtactaaaaattcaaaaattagttgggtgttgtggcatgcgcctgtagtcccaactacttgggagactgaggtgagagttttgcctgagcctgggaggttgaggctgcagtaagctgcgatcacaccactgcactccagcctgagtaacagagcaagatcctgtaaaaaaacaaaaaacaaaaaacaagcaaacaaaaaaacaaaacaaaaaagaaatcttgtacactttaccaacgccccccccaccaaaacaaaacaaaacaaaaaacatcctcccagccctgagcaagacattctctgtgtctacgtatttgcctattctggacattttatgtaaatggaatcatttggaatcattgtcttttttaaaggaaggataattctctgtaatggcaattccatttgtatattttttctaggctattttaagaatataactgaaggataaggggtagggtgaaaggattgcattacgccctgaatatcaaatgatgatattttgcttttttgctttgtattttattttagtcatcctacaatggctgaatcactaagtgaaatttctgacagtctggatgttctggaggccggtgatgagggtaagtaacccaataaaactttgataaccagaattagatttgtttactgtgtttatttagctcctaggacaaagaagcaaggcacaagaaaacaagttcagatcattagactcagtcacgtttacttttcagttttctaatttcttctttggcacctccaactctgatagtcaaagatttgcctgaggtcctgcaatcttctttgaaaatggttaccaggttttacttactaaggctttttctgcttcatcagaaaaaaccaatcagaacagaccatgatctgacaaattcagctgaggttttgctgtagatagtaattcagatctaagaaagagattaatttgttgaggagtaaaaggaggtagaaacaaaagatgcctccacaggcttctgttaaataggattaaatttacaaaaattctctttggcaaaacttactcgtgtatccattgcctaaattgtggcacaatctatgagtgataggtgatcatgcatggaataattagaaagggaggcaaatgtcactaaacaatgataagctttacacacacacacacaataaaaaggaaatcataagatgcaatgtgagacattgagtgtaaagacagaattgaattgaacagttctttgggttgttcttccattcttttgctgagttttctttagtggtgtatggtacagaaaactttgtctggaagaacagagggaaacctccttgtggcttcctgggggcctggcttcacacatgatgtggggcaggggatgctgagagcctgatcacagattcttaatggcagtgcttgggtcttcttcatctctgtgttatcactgtttagtattgtgtctcagagagagagagagacagagagaaaaagagagaaagagattaggcactccaaaatatttaatgaatgaatgaatgaataaatgagtgaaaggccttctcaccaaagcaaacccaactaccaaaccaattgactttttggatatgaactaaacagatgcctataaaagaaggtggcagcacaggatatcttgatgaagagtggtagcaacgaaatgccttttctctgttctcaagtttgttttttgtaagaccaaatatttgagtacagttttagaagttttagaactagtcagggctggccagagaataaggtggctgttgggaggttaaagggaagaaagtttagttagaaatgttttctttccagctgggcgtggtggctcacgcctgtaatctcagcactttgggaggccgaggtggctggatcacttgaggtcaggagttcaagaccagcctggtcaacacggtgaaaccctgtctctactaaaaatatttttaaaaattagccaggtgtggttgcaggcgtctgtagttccagctactcgggaggctgaggcaaaagaatcacttgaaactgggaggtggaagttgcagcaagctgagatcgcgccactgtactccagcctgggctacagagcaagactccatctcaaaaaaaaaaaaaaaaaaaaaatgccgggcgcgctggctcacgcctgtaatcccagcacgttgggaggcctaggcgggcagatcacgaggtcaggagaccatcctgtctaacacggtgaaaccctgtctctattaaaaatacaaaaaattagctgggcgtggtggcggatgcctgtagtcccagcttcttgggaggctgaggcagaagaatggcgtgaacccgggaggtggaggttgcagtgagccgagattgcatcactgcactctagcctgggtgacagtgcgagactccgtctcaaaaaaaaaaaataataaataaaaactaaaaaaataaatttctttccaagcagcaatgcaaaagaacaaagtcatcattatgcgatgtattttaaaagctcattcatttcaattcagatgggctgcctgtatgcattgtggataagcaaatatacaacttagaggcaaccatttctcattagatttagctgtgttttcttccctggagaaaaaacagccttcaatgagctgttttctggcatgtgacacactgcagaccatgactggatgagtatgttgaaagttacttgctgcttgggaatgcatagtctttgggctgagacagggaaatcagtggctttgttatagaagtccagacagctgtcagctctcagctgtcagctcactgactgcaactgctgtaccctgtgatggcataagttatccagtgtataggtgacccatataaacattgctgggtacaaatgtgagtttttacccatacctgctgtctagatctctctactctttgtgcttttcctagattttgaaaaacagcctgtggagggcttagctgctggtgattgaaaggtgcccccaccacactttaaaaaagaaagcttcaaaggccaaatttatagacttgaatatatggcaaccatctcagattccattagggtttcaaaagcaacatagcacatggacagtacccagctttgtatctcactcccagggctgagaccagggctcgtcttcattcatgggatagtgggggtggggggtgttggatacagttagggatagggcggtctcctaatggaaagcaggctgaagacatagacccttgctactgacattgtatgtctggcaatgggttgtcacaaaggccgtatccagctttcaagccactgacctagagcaacagcagccaacctaccatatttggcagttaccatctctccgtgtctccccagctccctgctaacaaagctataccaccaccacactcagagccacactacaggatggaatggaaacattctttttcttctagggtccatggttaaaagagacacccattgctttagctatttttgaatctttgcgggaaaataagttgtttctgcccagaaaagaatggaaaattggggggaaattggactatatgcatacttaactttcagcacctgttacagttccaaagtcactagtcattttgttaatttaggaacataaaaatgtgttaatgtacaatttttctgctcatacaatgattgtttgttgaattcattattacagcctaaatagtttattagacatgtttttatccagttagtcagtgtttatagattgtgtcacaaatggctattagctgctgactctcttctccctgtctttgctggattattagaagcaggtttgcaactcaggaattgctagggaatcctagctttgctttcctctcttccactatgggattttgaagcaagaggggcaacaattgctgtgtttctaaatcttctgagcataaagttgttcccctttcagaaggccagaatgagatccacctgtcaagaatcaataaatcgtctgggcacagtagctcatacctgtaatcctggcaccttgggaggcagaggtagaaggatctcacttccttgcccaggggagagtacagtggcattgtcatagctcactgcagcttcaacctcctgggctcaagcaatccccctgtttcagcctcctgagtagctgggagtgcaggcactaaccaccacccccagctaatttttcttttcttttctttctttcttttttttttttttttttttgagatggagtctcactctgtcacccaggctggagtgtaatggctggatctgggctcactgcaagctctgcctcccgggttcgtgccattctcctgcctcagcctcccgagtagctgggactacaggcacctgccaccgcgcccagctaattttttgtatttttagtagagacggggtttcaccgtgttagccagaatggtctccacctcctgacctcgtgatccgcccgcctcggcctcccaaagtgctgggattacaggcgtgagccaccgcgcccggccttttttattttcaatacagatgaggtctggctatgttgatcaggctggtctcgaactcctgagctcaagcaatcctcctgccttggcttcccaaagtgctgggattacaggtgtgagccaccatgcccagccttaaatattttattattgtagaaattatttttttctgaaaacacttttaaaagggatcttgcagaaaatatacgtttcctatttcattttcattttttattctttctctctttaggtagaattgccaagttttcccaaccatgcccctatataggcaaattctagtagataagaaattgcccaagtcatccaaaacagaaattacttaagcagcaattatcaagcaaacagttctataatctttcgttgctctactccatgctggcttctgcctccaattatgcatattgtacagttcactattcagttatagatatggggctgcttctaatgagatagaattgaatccagccctgataaacaagtaattactgagtccctaacactagctcacatttattgaacacttactacatgccagatcatatgctaagctctttacctatgtcatctataatttgcatcaactccttataagggccagtgtttaaattatcgtatgctgaaggatgactctgttcagtggtctcaagtcaaaggaagtgacaagctgtgttggtattctgcgctccccagtggacacagctgttactgcatgccttgcactgtgctagttgctaagggggatgctaaggagggcttgcctacagccttgatgtaggggcggtagctaagacatagggagctataacttctttctttctcacggatacccagaacatggtaagtacttgaccttaataaatatttgttgaatagatgaatgaacgaatgaatgagtgaggaggctaagaacattcagatgcaaaacttttgatgctaacagccaagttttaggtgttcagaagatagagagaagcatgagtttcactgattggtgggaaactggacttaaggcaggccttgaagtttaggaacctttaccctggcaggctcaggagtaatcggtgcacaaataagtcatagcatttcaaagctaaaggaactctagttcagcatttctcaaagtgttttttgccagacattccgcttacatacattgggagataatattgttgcctggtttcttggaacttcaccatatacataaccattttgaagtttcagaaaagttttgttgaaaagcaggctactgaactttgtctaatccagaattttccagattgactggactacggatccctttctcatacaacaaatcttatgagcatccctctgaacacactttgggagatgctgatcaggtgcaattctttaattttcctgctgagtcccagagaggttgagtgacctactccaggtcacagagctaattgatagtgaattcaagcctaggattccagaattttctgactcttggatggtgctttccattacaccattaagcctttcatgatggctgctgcattggcaactcccttgtctggacccttcattgccagcacagaattgctgtgctgatgagaccttctggagaccagacagttgagacttggaatgagacaacttagttggcacttgttgcatgtgaaatcaataagagctaattccttccctttgaagaatgcagcacgagccctctcccccttctcccctttagtttcttaataagcacaataaagacatatgtgcttattaagaaactaaagaggcccggcgtggtggctcatgcctgtaattgtagcactttgggaggccaaggcgggtggatcacttgagcccaagagttcgcgtttgagactagaactcaactctagttctagaactcaactctagtttctagagcgtcgtctctacaaaaaatccaaaaattagccacgtgtggtggtgcgtgcttatagtcccagctactggggtgggactgaggtgcaaggtgcaaggtgcgaggatggcttgagcccaggaggtggaagttgcagtgggccgtgatcatgccatcacactccagcctgggtgatagagtgaggctctgtctcaaaaaaaaaaaaaaaaagtaaagcccaaacagacagcaccttaagggcatttaaaactcacactcctcactgctgccctggtaattattatagatagagcaaactctcatttatctgcatgtgcaaagggcagcagccctgtagataatccaaaccaattggcaagacttgaagaacacacacaatgatcatcatcacacacacacacacacacacactccttgaaaaactctttggtatctgattttgacatgccttttacacaggcagcttctttgcctgggcagccctttcttctttctgattcccggccatctcccttgctcataaattccttcctcaaggaagtgttcctggactgcactaaccaaccgcactcactctttgggtctgcatcctttgagcacgcaggctaggaagtatcaactgccacttagacttggatttctaagggttctgaagtgtttttcacatgtgggagcttggctctcctattggattgcaatgactccagccactggggtagagtcaggggagtactaagtgctttcattgcctcaatcattgcttcacatgaatgaacttcttaggacaaagaaagaggtgtatatgttaatagctgaaattgagaggcaagtgaattcctagtgagtttggcctgaatagcagctgcccagagatgacaagctgtggcctgggcttctgcttttaccagtaactcagacactttgttactgagttattaaggggacgactaatcaaatgaatgttgaagggtgctgtcagcattggggttgagtccaagctctgcaggacacctgggtgggatcatggtcctctttcctctcatgaaggctctttttcctctcctgtcttcccttctaccatcacactctgcctcattttcatttttcacttccaggaaagaagaaatgcaaatttaaagcccttaagagcttttttgttaagaagaaggaaaaagaagccgaagatacccaggaagaagaaatgctagaactgagcttgtccagcagcaacattaacatctcttctctgcagcccgttcgggaaaatcaaccaactaaggccaggtgagctcagatgcggtggagagtgatggggacaggggaagaggcaggcagttggatctaggtcacctttcggcagccaaatcaccagggacaccaagagtccccacctgtgggggccaggcttgcagccattgccaatgcagtcatgtccgggggaggggggtggtgcttttctctgtgtgcatatgcatgtttgttgtctgagctgcacatctcagtgggttggagcatggcaaatgcataccccacttcccgagagcactgaataagagggtgcagatattcagggaagccctgcctgtcgcaactaaaataacttgagatgtggggcctgcagccaatgaggagctgaaggcctgtttgatctggtaagaagggcctacgtcattcaggaggcttggtctggtttgcttgcctggctctcagactaccgatctagccaagatctcataacaagtgatgaaagcctcctatagtaaagctatctagctgggagtggggtgggtcatgagcatgagatcactgtgttgctgtaaaaacacacatgcaagcaaacagcccagatccctttctccctccatttcaggagactaggggaaatgctatagtcacagggggcatggggaagactgtttccagctaccactgccaccgctgttcagatattcatctgcagtgcccaaatttccacatcctattgtgctatctggacacctaggattcccagctgtctctggatcaatcagatccccctctatgaagttctgcttaggcctgttcttctggccttaaatgccagacttatctggactccccacagagctcaccagtcctgctgcccgctccaaccaggcaaagccttgagggaatgaggcagttagctgacatgttatactgtccccaatatctcccccaatacattctataacataatggcctgatagttatcatatatggctccttaagaacaaccttcatgagtgcatccagtgtaaggaatttcaagtagtcttgctgggagtagggcagacggttttgaaagaggggcttatgtagtacctcacaagtaatactattatagcccattgccttgcagtgttcagtaagactaagactagccctgctaaaacccagggggaggtcagggaggggcattcaggtttactatctctgctaaagttctacatttctcccttttacttgttccttcctttccagaagtgtgtgcacatgtgaacctgagagagagagagagagagaagggggggatttttttgtgtgcaaggaaattcaaataatataacttagggggcctgaagatcacccctggtctcagtcttctgcttaatgtgctaggggaagaaaccctggaaaatgtcactccggagaagggagatcagcttttttcattcactgaagcaattagtcataacgaaacttatgaccagccttcccctggcctgtaccataggaccagcatctatttccaagactgtattaagccgtatctgatggaatggacaaatcccgttccttcatttgatttcttaatgagtgctgttgtaataatatacttcactgcccttaattaaggctgagattttgtttgggagtttttatttttatttttattttcgcctccagggaacagatcaatgagcacaagatatgttaagtggacaagagttttcatttctgacagacttggccacaactggtgctaatttaatcttttgatcagggagggcttggcactatagagccaattcaaccatttcactttggttaatgcacagcatggaaatgagagacatttctaagcccactcatagcccaagatttcctctcactttttctgcaaaaagcagaggaggcaaggtagtcacagatgctacactggttctgaacctgatttgagccagtagatcatagagcagcagtgaatgaaagcgtgttatatgtgcatactgagcgtatgcgtgtatatagagatgtctggaaacattacattctcaatgctggatcaatcatatatatatccattaagtgtttatctagagagtcacagtaattttctgctggactgctgttttataaagcagactacgttgcttccaacaccagggccacctggatagcagagttttatagggaaaaggtaagtaggagtttagtaaaaagcagcagacatctctctcctctcctctcctgttggcccacaagccatcttagagcgggttctgttttaatccccataacatgagattgtccttatagtgtgtcattatcaaatatatccatatgaagtccccacaggctcataatgacagggcaggtgctagccccacaatgcccaagctgctactctagttaccatttgaagattttttttaagtgctaacataaatgtattgttttgtaataaagataataagtacaaaaagggcatttaaacattttaaagtttattttatctgtttttaaacattgctacccctccctaaaagaaaccctgtaccaattaacaggttcccccctaaataaccactaatctactttctgcctctataaattttcttattctggatatttcatgtaagtggaatcatacaaaggttgtttcacttagtatgttttcacttagcatgttttcaagagtcattcatgttgtagcatgtatcagcttacttgcttttttcttcttttcttcctttattttttcgtgtctaatctcatcttttatataaacatacacattttctcctacctaacaggaataacttttatcatttaaaatttttatgtttctatataacagctttcttgaaatataattcacatactacaaagttctaccttttagcatgtgcagctatcactattacccaattttaggacattttgtcaccctaaaaagaaaccctgcgcccagtagcagtcattctccattcccctatcctctttcaaaccactgatctgctttctgcctctatggatttgcctattgggaacatttcccatgaatgaattatacaatatgtggctatttttgactggcttcctttcacttactatgttttcaagggtcatttatttaaaatcatgcatcaagaacttgatttcttttttggtagcagttttattgagatataattcatatattatacaattaaaccacttaaacggtaaaattcaacgttttttgtaaatccacagagttgtacaatcatcatcataataaattttggaactttttcatcacctcaaaaataaactcctgtacccattgaccagtcctccctattcaaccttcccccaacgcccgccaggccctagaaatcattaatctgctttctgtctctgtggatttacctattctggacatttcacatgagtggaagctggtcttttcttattgacttcttgtactcattataatgttttcaaggttcattcatgttgtagcatgtatcagaatttcatcctttttgctactgactgtccattgcatgactataccacattttatccattcatcagttaatggatatttgggttgtttccaccttttggctattgtgaataatactgctgtgaacatttgtgtataagttttggggcagatatatgtttttatttctctgggatatatacctaggagtggaattgttgggtcaaatggccgttatatatttaaccttttgaggcactgctagactgttttccaaagtggctggaccactttaacaccagcaatgtatgggggcaccaccagcagtgtatgggtgttccaatttctccacaaccttgccaatgcgtgttattatctgaattgaatttttcattctagccattctagtgggtgtgaaatggcatctcattatggttttgagttgtatttccctgccaactggtgatgttgagcatcttttcatgtacttgttggccatttatatatctttggaaaatatatttgtatatctttcttgtttggagaaatgtctattcacatctttttttattttctaattgggttatttaaatttttattattgaattccttaagaattcaataaaaagaattcctattagtaagaaagagttctttatatgtttcagatccaagacttatcagatatataatttgcaaatatattcttccattacgtaggtcatcttttcattttcttcctagtaacctttgatgcacgaacatttttaatttttatgaaatccatttgtattagtccattctcactgctataaagaactacctgagactgggtaatttataaagaaaagaggtttaattgactcacagttcaatcatggcagaggataaaggggaagcaaggcacgtcttacatggtggcagtagagagagagtgcaagcggggatgccacacacttttaagccatcggctctcatgagaacacactcactatcacgagaacagcatgggggaaactgcccccatgacccaatcaccttccaccaagttcctccctcgacatgtggggattacaatttgacatgaaatttgggtggggacacagagccaaaccatatcactatttatctatttattttttcttttgttacttgagcttctggtgtcatatctaaaaatccattgccaaatccaagatcacaaagatttactcctatgttttttctaagaattttatagttttagctctcatatttaggcctttaatccattttgagttaatttttaaaattacactttaagttctgggatacatgtgcagaaagtgcaggtttgttacataggtatacatgtgccatggtggtttgctgtacacatcaacccatcatctacattaggtatttctcctaatgctatccctcccctagccccccaccccacaacaggccccagtgtgtgatgtaccaccccccatgtcgatgtgttctcattgttcagctcccacttatgagtgacaacatgcggtgtttggttttctattcctgtgttagtttgctgagaatgatggtttccagcttcatccatgtccctgcaaagggcatgagctcatcattttttatggctgcatagtattccatggtgtatatgtgccacattttctttatccagtctatcactgataggcacttgggttggttccaagtctttgctattgtgaatagtgctgcaataaacatacatgtgcatgtgtctttatagtatttttatatatgttgtgagataaaggtccaacttaattcttttgcatgtggatacccagttgctccagcaccatatgttgaagagactattcttttttcattgaatagtcttggcacccttgctgaaaatcaaccatagatgtataggttcatttctgaactctcaactctatttcattgatctatatgtctatctttatgctagtgctacactgtcttgattactgtagttttatagtaagctttgaaattgaagtataagttatccaactttgttcttcttgttcaagattattttggctatttgtggtcccttgcatttcactatgaattttaagatcaattttctggaaaaaaaaaaaaagccagcatgaaattcaatagctattgcattgaatctgtagatcattttgtgaagtactgccatcttaacaagtttaagtcttccaatgaatgaacatgggatttcctttcatttattcaggactttggcattttttctcatcagtgtcttatagttttcagattatgagttttgcgcatcttttgttaaattgacttttaagtttttattcttttgttgctattgtaaagggaagtgttttcttaatttcattttcagattgttcattgcaagtgtatagaaatacacttgcatccttcaactttgatgaattcatatattctagtcatttttagcgtattcattaagagttttatacacaaaattatgtcatctgtgaatagagataatttcacttcttcctttccattctggatggcattaatttcattttcttacctaatttcccggtctataatctcccatacagtgtcgaatagaaatgataaaagcagtcatccttgtcttgttcctgatcttagggggaatatatccagccttcaccatgatgttagccgtggtttgtcacagatatcttctatcaagattgagtgcatttatcatggaagggtgttgaattttacaaatgttttttctgcatctattgaaatggtcatatagtttttgtttttattctattgatacagtgtttggcattcactgattttcatacattaagccaatcattccttgtaaatcctactttgtcatggtatacaattctttttatatgctgttggattcagttcgtgagtgtgttattgaggatttttgtgtctatattcataagagatattggtctgtagtttgctcttcctgtgatgtctttggttgaaattttttaaaggtaaaatacattaccacactccaaaaaggagtctttcatgtctttagcctttcatttgtttttatctttcttctgatttttcttaacatgtaattatcatcaacctggcaccattcccaatcagaaggtattttcatctggatttagcaagcttggggaagggaggtgcaggtggtacataggatgactttgaaaataggatagatatattgtagagctcttgtgtgaaagaggaaaggatctgatgaattaaagccttgtgtatctgtgaagatctttgattttttttaaatcaaaacaaaaacacgagagaaatttggatgtgaaagatcttttataattctcactgtaataataacaaaactcatggcctttcctcccattccccggaattgccactattgaattatatactttaaatgggcaaaatgtatggcatgtaaactatatctcagtaagactgttatgtaaaaaggatatatgctcataatgtaaaaattaaaattatacagaaggacatgaagtagaaaatgaaaatttcattcctgtccctagtgcgccattcctcagagggaaccacctctaacaatttgtggatatccttctagacttttttctttgaatatgaactatatatgtgtgtatatattaaatgggaccatactattatctttttcacttactatctcatgaaccactttctatgtcagcacatatgcatccctgctctccttctgaggtatctatggtaggccatattatgaatatacatttgtcttcagttcccatggcccttgggttgcttttacaagacctttcctttctgtccagggccaagagcagcatggggagcaaagccctatcccatgatagcatcttcatgttgggtcctgagcctgaaagatcagcaagtaaaatgtttccttctatggatccccagagaggcagacctcagcaggtaatagtggactcgagcatcagtgtctaattggactacttctcttctgttccctactctaaccctgccaaaattaaaaggagtgggaacttggttctgcttctcagctgatcctacccccacagggctgttgtaagccttgagtgacagaatgtataaatatataatgtgcctattacctggcacacagtgttgattagtattgccatattcacttctttttttttttttttgagacaggtctcactctgtcacctaggctggagtgcagtggcatgatcatggctcactgcagactcaacttcccaggctcagcttcccgagtagctggcactacaggcctgtaacgcctggatgattttttggtactttttgtggagacagggtttcaccatgttgcccaggctggtctcaaactcctgggcccaagcaaccctcccgccttggcctctcaaagtgctgggattacatgcgcgagccaccgtgcctggcctatattcacttctcttaacacaccataagaataattattttggcagcaacattccactgtttatgtgctggcataccaatcctcaagtttttttctctctctcttacacagagatcccatatttccagaactctgcctaaacctaggagtaaggttcctggagttgtgtctggagccatgtcaggagctgtgcttcaaaatgtgcctacaagtgcagtctgggttgctggccccaagatcactgaggtaacaaagtggaattgttcagcgcatgggcagctgagtcagaaagacagatctatgcttgaattcctactctgctacttactggctgtgtgacccctgggctagttgattaacttctctgggccttcttttcctcatctacagtgggtataatattaacatctacctcaaagggttgcttgtgaggattgaatgaagactcagagaagttaaagatattgctcaagcccaccctggtagtaaattgtagacttggaaatctgacccaggtgtattaaactcaaaccccatgatctttccattaccccaagatgctcaacttctttatacctgcctggacagaaagaagggtacaccttagcacctacataatgtagcatgtatgtagcatcttgcctccagctaatcctaaacttatggtagggatccattgctcagtcagagtatagctctgatccagaaatgcttcagggggagctgaagatattgtcaaggagacaacccttaacagctgccttccccgtctcagcctgtgggtggaattatgcccaaaggtccctgtgtaagtgggaagagaacaaggaggagacccttctccattggagagatgattattttccatttggcaaaaggtaagtggggcttatttctgacatgtctgttaagaccccacatctctcactctggtttcctttcttctggatcctttagctatagaggagaaaacactgagatagacactaatggtgttgaccctaaagttgttaagcagcccctagggtcagaagactatttccctcttgtactacagcaggaaaagtcacttccatgaagtattcaatcttcagttttaaacatcaacactagctttcactcacctccatagttacactccctgcagcctcatgaccatgaccaagtggcaacagggttctcacattcagaaagaggaaactggtttcttggactcctccttctttcccctcctctctaagtcccagcaacagagagactcatatagcagagatattccatttttttaaaaaaattattttttgtgaaaattaaaggaaaatattctaggggcattacttctcacaaggaagtggttggggaaggccacaatagcctaaaggcaagctttcttaaatgtttggcttgggcctatacctcacacttttggcctgatcccttagttgataccctggaaaacaaggctgaagacaacatagggtattaataggacctaagttatcaacaaccaacctgacctttgcatgggaaatttcccttaagtaccaaaatgacaaccccaatggaaggatggttgatagcattaagtcaagggtcctgacacccagtgctacataaaagctggggcaagcatgaaattggccagtggggtcaattcccttgaaggggcaggattctaatggattaagtgacattcagaacaacgaggagattgttaaagaagaaatccaggtatacagttatgtcagaaatactgacactgagccaattttatttcctgccagattttcacctaatgtcctatctgaagtgttaggaatgtggatgcctacattactctccaagacattttctgttccctttatttgagcacaaatagttaaaaagatacaatggcagattattagcatcttgctgttgttgaatcaaattgaatttagtcatttaagaaactgagacttcaaaacagtttttcttactgctcacgggcttgactgtccctcagcccttcttaaggaagcaggcacaccatatgttctggttgttgcctttaaacgtcttgaacttgggcttcagtatgggctctcccttttctggctcttataattaggagacacgagttcacagtgatcaagaacaagggctatcaagctggacagacctttcaaatgcttgctctgccactgaaagaattagggcaggttacatcatctctcaaattttgttttccccgtccgtaaaatggagcccacaatagcaaatgcttcaaagaattgttgtgaggcttcagtgagatgtatctatggagagcactctctgcttagcacattgtaagctcttagtaaaagttagttgtcattattgtaattattattattaaagctgggcttggaattggttgatatggcctctccccaagagctcccaatggggcctggtagtaataaggaagcactggagacactggccaggagcaccccaggagcacaacctttgtaagcttcactgtggttccttctttggctacagtgtctgaaggctatctgccctgagctgagcagagtctacaacagaagcaagtatgtcagcttcatgaccacaagaatttgttttgtttattgttgtaggcccatttcctggaatggggtgtaatgcattgcagattcttggccagtatttgttaaagataaaaagcagggattctgacccacatcaagaggaccatggcagggaccagtgtctcaaagtcaagtgtaccattttcttcaaaatggaatcaactaaattgtctgctgaatcccaaggaaagcccaaatgataaatttttgtccctttaggaaaccattccatagattttctttaaaatctatagatttttaaattctgtagattttctttaaaatcccagaaaatcattattgacatgattaagataagcaactaacacagtcaagattcaatccaaataattccttgaataataggagcaaagagtgcagtttggatgccaattccaggtcataactcaaaagactcgcctctatgagaactggacttccaaagtcaaattcagacattaaaacaaagatcagaactaaatgagatttgtatttaacatcagtaaggagataacatcaggattctgatcttgcacgaacaagcaatttgaagtttctgtctttgtttggggattggcaaaagtgtgcagcaccccagaggggaaatcaaggctagtagtctttggtttgagtaggtactaggaatgaagacggggaggtaggaaattcttccctgggcttatttttttcactttggattcttagtccttcaaccaactttggattccttactcttattaaagaataagagaaaaccactaatttgaggaagagagcacaggttttaaattgttccttctattctccctcttgacagaacccaccatcgcgccgacgccgactcagcatcatcccacctgttatccaacctgaaataatttctaagaacttggtagaaatctctctcgatgatgagtcacctaagaatccacaaaagaaggctttaccacataagagtttgacagcgactcaggtgagtatatattaagggacaggttgaggggcctcacagatcagaggcataacttcttcttgtatcatctattctcccgctggagctcaacactagggggatgattggggaaggacctgacattcttggcttttgatttgcatggtggttttccatccaattctacaaaccaaataatcaccattttaatgtataagcaagggaagatagtattttcgaaaaaataatagtttgcagatgttttgagttatttcatgaagataaaaatacagacttttactgaagcatagactctacacttagaaatccaaaaaaatcagaggttaggacatatagtattatttgatagacacatatccatgtgaaaaatcagttgacacgtgagagggcgatgtgtctatttcatatgtctaggtttgtcaaccagataatatcaatcagcgtataatagtgtgtgctcatatcaacacttccattctcaaactaatgtgtgtttaattgaattggttgttggtgaacttgaaaaggctctgagagtgaggtagagtttagaatgattaacctttggaaataaaaagtaaacagaaacctaatttatagggaagagaattggccagtcagaacaaaactctattttgatgttaaaagatcctatgaagtgaagcagccctcagttagatatgtcaacaaagaaattaggttaaaaccaaagttaaagcacagactggtagtaggtggatggatgcttattgttttatggatctgggctatgactacaagtattttctgcagaatgccactaaatcagatgaattgggatgtataatctgaactagtggaaggattgaattagataacattttttattgtagtaaaatacagatcacataaaatttaccattttaaccattttaaagtatacaattcagtgacagtacatacattcacaatgttgtacaatcatcaccactatcaaggtccagaacctgtttggttctccaaaatggaaaccccgttcctattaagcagtcattcaccattcgtatctcccatcagcccctgacaacaactattctgctttctatctctgtacttgcctactctggatatttcacgtaaatggaatcatacaatatgtggcttttgtgctggcttctttcacttagcataatgtgtttgaggttcatccatgtcgtgacatttatcagtacttcatttctatttatgactaaataatacttcattatatggatgtaccacattttgtttagccattcatccattgatagacacttgtgtcctatctaccttttggttattgtgtatagtgctattatgaacattcttgtacaaatttttgtttgaacacctgttttcaattcttttgggtatatacctaggagtggaattgctgggtcatatggtaactctatgtttaagtttttgaggaactaccaaactgttttccccaacagcaataccactttacattacatccccactagcaatgtatgagggttccaatctctccacatcctggctaacacttgttaggttcctgttttaaaaaaattatagtcatgctagtgggtgtgaaatagtatctcattgtggttttgatttgcatttctctagtaaataatgatgttaagtatcttttcatgtgcttgttagccatttgtgtatcttctttggagaaatatctatttctcctttgcccatttgttaattgggttatttatctttttgttgttgagtttgtaaaccagaaaagtacctaagacaggtcagaaacaatttcgaaattttattttgccatggttaaggatgtgcacctgggaggcaggtctgtgcctttctccaaagataattttgagggcttcaatgtctaaagggggaaaaggcggatattggggaaagatgaccacatttttaaaaggtgtgggaagataagagacaaatggttgcatttttttgagtctttgatcagcctttcactgaatacacaatttacatgtgagagggggtagaggaatagtcacttatgccttcatcttcctcagtgaatctgcatttttacatcagaagaagcaatcaaatatgcatttgtctcaggtgagcagacggatgagtttgagttttgtcctttgtcccacacctgtgaagataagctatcaatatacattgtcagggtaaaattcttaaagcttaaagtttgggctgattaaattccctggcctcagtcacattgcaggataaatgctggcatttaacatttgggggttaagttattccactgaattggctaataaagagttaattttgagtgctacaagtatgcctctttttataatatctcatgctttacctggatggcttacaccataattccccagcattgtatacaaataagtctccgaagcccagagccatcttttttttttttaaagcaatcttctgctgcatatgcctgtagtcccagatactcgggaggctgaggcaggaggatcacttgaggttaggaactccaggctgtagtgcactatgatcatgcctgtgtgtagccactgtacttccacctgggcaatgtagtgagactctgtctctaaaatgaaataaaattttagttttaaaatccgctaatacatcaaaggagaacataatgctccctcccatgattgtatacaaatttacaactttcaaagtgattttccttatatagttacatttgattctctcaataactctgtaaagcagataggaaagattctcattaaagatcaaaaaaaattgaggttcagagaggtgaagtgacttggccaaggccacagagccaatcaaagatagagctggggcttgatcccaggactcctgaccaaatccatagcacttttcactgaactatgtggcttctagcagtcctctttttataaccaatgcccagcaatagcaacgacagctaacatttatcaagactttcttatgtaacgggcactgtgttaaacactttccttgtataattttatttaatctttacaacaacaaaccaaagtatgtattatgattattcccattttacagacatgaaaactgaggctcaaaagggctagggaacttgctcaaggtcagacagccaataagtggtatagctaggatgtcatattcaggcctatttggtttcaaagtccatgttcttattctctatactagttaagaaattgaagagattgtgatagaagggggctgcagggaataccagaaattccatctctaagaactttcaagttggcaaaaatattgaccacaacagcttttaagtaacatagattttgaatgaagcagcagctgtgcaggaactctcaggaatgggcacagaagccactttgccacacccagagaattaaaatccctacagccattattgggtctcacactctgtgccagtacctcttggtgcagaagtctcccaccaagaaccacatttcccaccaagagtcgcttcttcttgtggagatagacacatgcttttagcttttgactcacatagaacccaactctccaacatcccagtgtcagtttcagaatgtattttttctcaagagtgacagctttatgggccaaatgcttgatgaaatctgggcctagacagccacctggtaatccccttatttaagacattacaatcagagctttcctttgttccaggaagacagtcaaccttctctctatccctgctcaaaaggggaaaaccctagcatcatacaacagaaaaagaaatcattaaaaaggactaccaaaatgtgcattattgactaaactcctttgcactgggtctagaaacttgacagaagggaaaaaagaagtgaaaatgtgttattattttccaaagagcagcccttatcccagctaacagcaaaagagtgtccagctctctactaaccagtgctgaagaatcctttcccctggcccaaggtccaacccaggttccttctctaagaagattctggattagtaggtaccaggccgggcacatctcccagatgttgaggcacaaggagcccatttaattccagatattaatctgaagatatctgtgctaaactctctctaaaacacaggagaagaaatgaaaacatctcagctgtacttaataatatacataatggaccaaatgttctcctttataagtgggagctaaataatgtgtacacggtggacatagagtgtgggaaataaacattggagatttggaagagtgggagtgagggaggagggtgagggatgacaaattacttaatgggtacaaggtatattatttgggtgatggttacagtaaaaataaaagctcagacttcacctctatgtgatatatccaatatatccatgtaataagctacgcttctaccccttagatttatacgaacgaaaaaataatatgcagattgggttcagacagggtatgttggctgtcagagtgcgtggaaggagaagtagggttggaggggagtgaggatggaaaagtagagaaaggtgtcccactttctccactcgtttttctttcagaattctgccaggaagggattctatttgcttttcttgggcaactcataaaatcctgtggttggcttctgtggtagctttttttttttttttttttttttttaaagacagtcttgctctgttgcccaggctggagtgcggtggcacaatttcggctcactgcaacctccacctcccgggttcaagcaactctcctgcctcagtcccccgagtagctgggactacaggtgtgcaccaccatgcccggctatttttttttgtgtgtgtgtttttagtagagacggggtttcaccatgttagccatgatggtctcgatctcctgacctcgcgatctgctaggattacaggtgtgagccgccatgcctggcctgtggtaactcttctaagttgctgctaaccaataggactgagggaaagaggacctaagaaggcctaagaaggagccacacttcccaaaaggaatccatatatttctgactcctgttctaaggcaactgatgggattattcctgaacttgctgtactcatatttgaaaatgggagccgttctcttcatgctagaggactaggcattggttctcaactttggctcctggaagactcatttggaaaccctgttaaagctattctaaagcctttcccctgatcttcttactcattaggtcttgatatgtccccgaaatgtgctttttcaacactcattccaggtgattttggtgctgggggattccagaccatacattgagaaatactgtgtagagttccagagagtgtatagtttatttaattcactggtgagttaagggaagtcataacatatacatataatctatacccacataacatactctaaacctaacaacagagatcctgttaagactgttttaaatcacatgtctgagcttgagctccatagtcagatgaggagaatgcttgatcgttttgctctttaatttttagccccggtttgagaatggatgtgggtctgtgtttagactgatgtctatagattccttagtgagagtcaagctaacacagggagatcagtggctgttattaagtttgatggactcttggcttcggctgtgattggaaacagataaactctgtcctgcacatacccaatctagaaattgccagatttttgctgagcctgatttttctgttatgctatagaatgagtttcactaaagtaaattaagtatctttagtgtttataccacaaggtttgggatgccaactgaattgaaagttctttatatttattaaatatgtacttacttgccatgtgggcatcataagttggctttcatgcaaagcaagttgtacggtgttcttttagggtttccagattcatagacctccttgtttttctccttttacctttggctggagctagtgaggcctcagaaagaataactaaaataatacagagaacagaggagcttgctctgatgacatctcagaaaggcaacttctggtggaagcctttaacgtaatcaagtcaccagttcaaaaaacatgttttgagcaactaccatgtagtgcttgtgcaactactacaagcacagttggaggtactgtatccccaatacagtagtacatagaacagataaaaacccttcttcatggagtttatattgtaatgggggacatggacaataagcaagctaaataaggaaaacatattgtatgtcagacagtgagaacagtgacagggagaaaaacaatgtaaggaaggggatatgaagtggctcaaacattttaaatagattggccagggaagacatcactgaaaaggtgccttttttttttttttttttttttgacggagtctctcgctttgtcgcccaggctggagtgcagtggggtgatctcagctcactgaaacctccgcctcccaggttgaagtgattctcctgcctcagcctcccaagtagctgggattacaggcatctgccaccacacccggctaagttttgtattttttgtagagacagagtttcatcatgttggccaagctggcctcaaactcctgacctcagttgatctgcgtacctcagcctcccaaagtgctgagattacaggcgtgagcccaccacaccaggccatgaaaaggtggcttttgaatcaaaacctgaaaaaagtaggggagctagccacatggacatgggggaagagcatgcctagcagagggaacagcaggcacaatggccccaaggggagagcatgcctgaagtgcttgaagaacagcagaccagcagtgtgtctggagcaggaaatggctggtaatgtggtcagggataaaaggaagacagatcatgtgaggttagtgggagcatagatgttatcctccagccccaaaagaccagaactatgacaccactctgaggtatgaaagatgttcagaacaataaaagaagagcttttagtctatacactgatatcaaatttatatttccagtagataacataatctaactagatgatatcaggaagaggcagtatataaattcatagatgaaagttgcacaaagaagtaaaggaaatcttgggatcaatcctacttttgtgtgattgatcccacaaaagtcaactgtactatttctctgtcttctccctgaatccaaaactgaatggtctgcaggatttgtcatcagcctgactcattagcactgcgttaagtccccatgcactggaatgacagtgccatcttcataaccaagatagtagctaaggttatcactgcatcaacatacaatggtggtgggaaccatgaaggcatgtgaaagctgcaagtaccaaggggatacctggcactttgcaaaactagcctgaagagaacttagtgggtaaacacaatgggagattctgtctacttgctaaattataatatatggtttgctactagtatctagcagagacagtttatcagctgatcttcaaagggccttctgctaacagaaatcgaaatcttcttagaaatggaaagagctctggggaggctctttgagatatggaaaatgctatgtccagaagcccagaggagactattttgaagatcctacagaggaattcaactaggtgtcccagaaccaaatagtatggagatatggaggccagccataatgaggacagggttacaggctccatcactatcccactggaggttagagcattcagttcctgagggtcctcccatcagtcttgcacccatgaactgtcaatataaataaaaggtagtgtgctgtctatgaaaatgcaccttgcagacaggccctcttccaacctgattttcctccctccacccaaccctccaatatagaaatcccagagctctgctgggtttcactgataccaattgttcctctcaccccagccagatgtcctgttgataagaaggggatctaggacaagagaacatgcaatctctctgactttgcaaactcaattaagtggttgtgttcccatcccaaggacaatggggtgcccctgaaagctttctaagcagaggagtaacccaaacttcttcctgtttcttgttttcatctgcaagaaaaccagtaaaattatggagcttacctctaatgaataagcccattgacaggaaatgtaggaaaggggacaatagttcatgaaggatttcttctttgggaattcttcagccggaagaatatccaacttttgagaccagtaacagcatacgggttgactcgtctattttctcccaccttccccagagcttctctgagttatcatctggacctgattgctcacagtccttgactgcatttgccacacttgcctctaccagtagcacccagctgcccattggtttcagcaccccagccaccacccagggctgtttggattcttcagctgctcgccacaaaatgactttaaatccccgcaaacaaaagaagaaccttcaagtgattgtaagtccttcaagagacagggcactaaactcctgtataagaaaagatgagttccaacctttgcaaactactactagggaaatagtatggtgtaggagactcatgccctaagtaagcttggcaaggtcaagggtgctgtcctaagcttgacacccccagaggggtgagcaagcttgcatctgctgggtgtggtttcctatccatgtggaacttatattagaagggactaaaaggaagcagaaacagtaaatgatttaaacccccataaactgcttattgggctaacatctgggagttcactcagccctatttgtagagaatattcaaccctagcccagatcaggattctttcagttattaatcagatgagacccatgagtcacaaattgcagcactattccacttatttggagatcaagctttcagcaaccctaaacatccagaacttagttgttaacccatccaaagatctccaaatagatgccacatgactttccaggaagcagacctactgtgttaaaaacatggccacagattagactcagacctgacagcaaagagaagtgacagctggtagcagacagaatgacagaaacaatctggggccatttaatataggggctcaagaaccttgcccacctcaatatgtccttcagggccacactatatcatagtccaatgtaatagataattttattatttgtccaagtcatctagaaaaagtagattattttccgtgatccctgtttaaaaagatagagaaataatgcttttggaaaaggcttttagtaaaagttaaggattagggctgggtgcaatggttcatgcctgtaatcccagcactttgggaggccaaggcgggcggatcacctgaggtcaggagtgtgagaccagcctgaccaacatgcagaaaccccgtctctactaaaaatacaaaattaaccaggtgtggtagcacatccctgtaatcccagctactctggaggctgaggcaggagaattgcttgaacccgggaggtggaggttgtggtgagccgagattgtgtcattgcactatagcctggacaagagcaaaactccgtttaaaaaaaaaaagttaaaaaatgttagtgtttagtgtttaaaacgatgtgtcagttgtctataaaactcactttgatcaaaaactgaattcgccagtgattctgggctgaaaggaagagactgtaaatcagaggtgaagtgactaaaagattgtatagtacaaacattttacagagaagggcattaaagcacaaataatttcagatacttacccaaagtcaaacacccaggtgatagcagagctagggccagaatccagtcttctgacttccagctcaacacttttttcatcccaccatcttgcctctagcttaggcatctcaatttcactttaggttttagacaaaatacgagttgaaagaacaggtggaggagcagggcggcagagggaagccctctggtggccttgagagtaccttgttagtttggtgtcaaagaaggggtgaccaattactaggtgccaaaccctatacatgcattatcccctgaatacctcaccacaaacctgggagatggagaaggttggctgagggaagcagtatgacccttctaactttcttctttctgtatagcctagttgagaaaaagcccgggcattaccctctgagaaggccagagcatccacttcttccctgtgactctctctctgacatgtggatgaacataaaaaagatccaggatcatttatgacacagggactactaccactttctccctgctctgtaatttcttagatctacaagtcccacaggaggtttctcctggtcccttatttattgatgtagacacagtgattcagagaataacttgcccaaggtcacgcagcaagtaaatgatgaagagattttgaatccaggccaatctgaccacgtttactcaaaaataaattattatgagctgtgtctgtttgcacaggcactttgagtgggagtgtaaagagttacatgtttgtctttacatgcatgccataaaggcttacactaagcaaattccggacactgttcagtgcagtgctatgctgacatttccagagctgtattgtaattatcagaaaaccttatttatactaaaccaacttcagcccatccagtgtaagggctgaacctttcagctttttctcctttccctcccaacaaaaccccaattctttttcttcttttgatctggaaagagataattcatgctttcattacattccctgaaaagaagccaaaaaggatttgaatttgactcacaggtctggtgaagcaaatcggagaatcccaatatggccgagggcatgattgttgtcaggcccaatgaccccgttttcagattcgtggccttccagtgtggttcagtcatttccagggtattttagagggatccctgcagtgtgtcactcagacattagaaactccaaacctggatgaaccacttccagtaggtaaaatgatccccaaggatctcttggtggaaacaattccattaagaaatccctggaaatatctccattgaaataacgtccatctttaaaggtactgttacgtgcccagcatcaagaacttttttcctgatgctttttctttggcaaccatgcaggcgtggttggaaagcacttcagtaggattcaagctctttcttttcctgtttcaggtggaaccaaaggaggaggagccaaaccttccattggtttctgaagaagaaaagagcataaccaaaccaaaagaaatcaacgaaaagaagctgggaatggacagtgcaggttagcatatcttcaccctcacccagaaacatgtatgacagacttcattgcacagtgctatgttgataggagctatacccaagaactacccaagactgctgcccttggtcttcagagagctttcaattttatatgcagaaaatgttgtccaggcttctccatctaaactgccaaagtaatacaattgccacttgtgtggggttcaggtaaaggatcatacctggattcttattttatgtaaatgaatttccaacaagagaggtgttttgtttgtgaatttgtttcatcctctccgaggctaacgtacatgctgagttcctcagtgagcccagatatgagaggacaaccactgatttccccttcagcattcttcctcagcagcagaaccagaaaggaataatagaattggccaaaaaatcatttttttaaagttgcctttctcttcctgtagagagaaaatgtctgtgttaataatgatactattgcccacatccttggacaaagagggtttatgcagctgcagacagatgtccttggcagccaacacctatcaaatccccaaacaacaaatatcaccagagtgaaaatctctctgtgtgtttatgtgggtgcatatgtggatgttggctccagttgatggcaagctgatttctagcagtatttgataaaaaaattccagttcctcaaattaagttgaatagttatgttacgtttttgccacaaaggatttcacatgtgggtccaaagacaggacattcctaaacacgttttcccatgaatactaagaaaaccacaaaaccctccagaaaaaaaaagaaaaaggaagattaaatgagtactcttttgtctttttgagctttatttttatttatttatttatttatttatttatttatttatttatttaagacggagtctcactctgtcacccaggctggagtgcagtggcatgatctcggctcactgcaacctccacctccctagttcaagcaattctcctgcctcagcctccctagtagctgggactacaggcgcccgccgccacgcttggctaattttttgtatttttagtagagagggagtttcaccgtgttagccaggatgatctcaatctcctgaccttgtgatctgcccaccttggcctcccaaagtgctgggattgcaggcgtgagccactgcacccagcctttgagctttattttttaatagttgtctcttttacacacagaggatagaactgagtcagtatccatggtggcagatactttagttgattttccatatcatggaagtggtttggagcatagtcagctattatcagcgctgtatgctggatatgaaactactggatggagctaaggatgcagcagatagtgagggaagaaaggcacaaggggcccttccatctggggatcaaagtgagttccttagaactagaagaaaggagaggagtaatctgtacaactactaccttgtgcttgacctgaagcctgtggaccaatgcaattcttaaggcattccaagaatttctttgcatgtgtattacatatgatcggtttaaaaaaatgtttttatttcaatagctttaggggtacaagtggtttttggttacacagatggattgtatagtggtgaagtctaggattttagtgcacctgtcattagagtaatgtacattgtacccattatgtagtttttcattcctcaccccctcctacccttcccactttctgagtcttcagtgtctaatataccactctgtatgcctttgcatacccatagcttagctcccatttataagggagaacatgtggtatttggttttcgattcctgggttacttcacttagaatattggcctccagtttcatccaggttgctacaaaagacattatttcattctttgttatgcctgagtagtatcacattttctttagttgattttccatatcatgaaagtggtttggagcacagtcagctattctcagcgccgtatgctgggtatgaaacccctagatggagctagggatgcagcagatagtgagggaagaaaggcagcgagggacccttccatctggggatcaaagtgagttccttagaaaagtactagaagaaaggagaggagtaatctgtacaactactagcatgtgcttgacattttctttatctactcataggttgatgggcacttaggttgattccatatccttgcaattgtgaattgtgcttcaataaacatatgtgtgcaggtgtctttttgatataatgacttcttttcctttgggtagatactcagtagtgggattgctggattgaatcatagatctatttttagttctttgggaaatttccatactgttttccacagaggttgcactaatttacattcccagcagcggtgtataagtatgctctttttatcacattcatcccaacatctattgttttttgactttgtaataatggccattctggctgaggtaagatgatatcgcgttgtgtttcaatttgcatttccctcgtgattagtgacattgagcatttttcatatgtttgttgtccatttgtatatcttcttttgagaattgtttattcatatcctttgcccactttttaatggattattatagtttattgtcacctggcttcagctctgggtgctttcagttttgaagactctgtatgagttccttggttgcagagtatctttgtgtgatggctttctcagatgctgactgtagtagtgatgtgctgggtgtgtgcgcaggttcactgtctcctatggggagttttccatctggttcacagtgtaggctgctgcccatcacttctttcaaagggtctgtggtttctttcactctttctgttaagttcctgtgttgcttcttggaaaaagctcacagcatgaatatctacatgctatttgtctttccaagtgggagagacatgctaacaatgcctccaatctgcatcttggaaataaaaacaactaggattgttttaatgtaagagggtagaaaaaaagaagaaaagggggccataatcttgcctcccagataactcctattgaccccttcttaaaaaaaaaaaagcaacatggccaagcacggtggctcatgcctgtaatcccagcactttgggaggccgaggcaggtggatcacaaggtcaggagttccagaccagcctgaccaacatggggaaaccccgtctctactaaaaatacaaaagttatctggacgtggtggcatgtgtctgtaatcccagctactcaggaggctgaggcaggagaattgcttgaacccaggagtcagaggttgcagtgagccgagatcgcgccactgcagcctggtatgatgtatgaattcaaagtgtgaaatttgtctttgggtagagtgtaaaatagaaccataattaattttcaatttaattttcaatttcactccagcctgggcgacagaacgagattctgtctcaaaaaaaaaaaaaaagcaatacatgcacatgatatgaaatttcaggtagttcagataaatattatgtagaaaatagaaatgctaattagaaagtaaaaaattcaattcctccttccccagtcagtttccccacaggtagtcattgttacaggttcaaaatttgccttctgatgtgtctcacactgaatggtggaccagactattggtaaaaaggtgataagccaaccctggagtcagtttctagaactaggatttctctttggcttaaaaatatccaactgcagaaacctaatagtgaccatgttgccctctgtcttccaaatagctgcttcctcatactaggaaatttagtagcaaataggtaccactgggccagggcacagtattcttattttaggaagtgaaagtcacacatatttctcctttccttatttctgtttggtgcagattcctcaagccagaaacagaacaacaaaactgagatgtatgataagaagacaacagaccaggctccaaacactgatgcttctcggagtcagggctatccaatgtcagcagcatatggaagaagatggagaagaaaaggagcaagtgtttcaggattgagtgggtgtgaattcaaaggaagaagccttaaacaatccagtgaagggtatggcctgggcgatagagctgggtcttcacctaccaataagactgccaggaatgtccctttctcgcacttgtccttagagaaggacaacatggagcagcctacaacttcacaaccagaaaccactacccctcaggggttgctttcagataaagatgacatgggaaggagaaatgctggcatagatttcggatccagaaaagcatcagcagcacagcccatacctgaaaacatggacaattccatggttagtgatccacaaccataccatgaagatgcagcttctggagctgagaagacagaagccagagcttctctctcactgatggtggaaagcctttctacaacccaagaggaggccattctctcagtagcagcagaggctcaggtgtttatgaatccttctcatatccagttagaagatcaagaagctttcagctttgatttacaaaaggcccaatccaaaatggagtcagcccaggatgttcaaactatctgcaaagaaaagccttctggaaatgttcaccagacctttacagcaagtgttttgggtatgacaagtactacagccaaaggagatgtttatgccaagactctgcctcccagaagcctttttcagtcctcaaggaagcctgatgctgaagaagtctcctcagattcagagaatattcctgaggagggggatggttctgaagaactggctcatggtcactcttcccagtccttggggaagtttgaagatgaacaagaagtcttctcagaatcaaaaagttttgttgaggacttgagcagctctgaggaggagctggacctcagatgcctctcccaggctttagaggagcctgaagatgcagaagtcttcacagaatcaagcagttatgttgaaaagtacaacacttctgatgattgcagcagctcagaggaagacctgcctctcagacaccctgctcaggccttgggaaagcccaaaaaccaacaagaagtctcctctgcttcaaataatactcctgaagagcagaatgattttatgcagcagctgccttccagatgcccttctcagcccattatgaatcctactgttcagcaacaagtccccaccagttcagtgggcacttctataaaacagagcgattccgtggagccaatccctccaagacaccctttccagccatgggtgaaccctaaagtggagcaagaagtttcctcatctccaaagagcatggctgttgaagagagcatttctatgaagcctctgcctcctaaacttctttgccagcccttgatgaatcctaaagttcaacaaaacatgttctcaggttcagaggacattgctgttgagagagtcatttctgtggagccactactccccagatattctcctcagtccttgacagatcctcaaatccggcaaatctcagaaagcacagctgttgaggaaggcacttatgtggaaccgctgcctcccagatgcctttcccagccctcggagaggcctaagttcctggactcaatgagtacttctgcagaatggagcagtcctgtggcaccaacaccttccaaatacacttccccgccatgggtgacccctaaatttgaggaactgtatcaactctctgcacatccagaaagcactactgttgaagaggacatttctaaggagcagctgcttcccagacatctttcccagttgactgtgggaaataaagtccagcaactgtcctcaaatttcgagcgggctgctattgaggcagacatttctgggagtccattgcctccccaatatgctacccagttcttaaagaggtctaaagttcaggaaatgacctcacgactagagaaaatggctgttgaaggcacttctaacaaatcaccgattcccaggcgtccgacccagtcattcgtgaaatttatggcacagcaaatcttttcagagagctctgctcttaagaggggcagtgatgtggcacctctgcctcccaatcttccttccaaatctttatcaaagcctgaagtcaagcaccaagttttctcagattcagggagtgctaatcctaagggaggcatttcttcaaagatgctacctatgaagcaccctttacagtccttggggaggcctgaagacccacagaaagttttctcttattcagagagagctcctgggaagtgcagcagttttaaagagcagctgtctcccaggcagctttcccaggccttgaggaaacctgagtatgagcaaaaagtctcccctgtttctgccagttctcctaaagagtggaggaattctaaaaagcagctgcctcccaaacattcttcccaagcctcagataggtctaaattccagccacagatgtcatcaaagggcccagtgaatgtacctgtaaagcagagcagcggtgagaagcacctgccttcaagtagtcctttccagcaacaggttcattcaagttctgtgaatgctgctgctaggcgatctgtttttgagagcaattctgacaattggttcctaggaagagatgaagcttttgcaatcaaaaccaagaaattcagccaaggttccaaaaaccccataaagagcattccagcccctgctaccaaacctgggaagttcaccattgctcctgtcaggcaaacatccacttctgggggcatttactctaagaaagaagatcttgagagtggtgatggtaataataaccagcatgcaaacctatccaatcaggatgatgttgaaaagctttttggagttcgactgaaaagagcccctccctcgcagaagtataagagtgagaaacaagataacttcacccagcttgcttcagtgccctcgggcccaatttcatcctctgtaggcaggggacataaaatcagaagcacttcccaggggctcctggatgctgcagggaacctcaccaaaatatcttacgttgcagataagcaacagagcaggcccaaatctgaaagcatggccaagaagcaacctgcttgcaagaccccaggtaaggcttttatctctccagatggcaagcagatatcaagtggaaacaactggaaagcaaagccttgaatgggcattaaagtctattctagtcttttactgaattgtggctttgatagggctggtttatgagtttgggagcaaaatagtgccccattctagatttaatagatttggaggtagttaattttgagccttccctttcctaatgggatccccctctggacatccatctacattccatagtagacacatgaccatttccccattccctcttcctcaccctctgcacaccttacatttggatggaattttatgcttttctcaaaatacttttacatgtattaagcccctccctaacaccatgtggatttttaaagccaactcattcgtagagcactatgttcagtctctcagcctgaaatcttaatttgccataaatgtctcttcgctcatctgaaatatctaagaatttagagctaggcgatcttttgggcacgaatgtctcccaaaacctttggaccttcacactccatccttggaaaaatcttttatattcctgtaaccacacttatgtaaccacacacttgtgtgagggactatgaagtaacaaatacttttctaggatttttcaaagatttttcaaagatttttctaggagttagaggaatggcatcaatggcctgagcctctggcatccttgggattttcccagcccacctggcaagcgttgtcctactctgatttgcagatggcaccagggatggacaagggaagggcccacttttaagtacagcttctttactacccaaggaactcctgccttgccaagctatagggagggcccaaaaaaggggggccttctctgtttgatatctgtttattttcctttggcaattaacaagggtcccatttgggatattattgtgggtaagccccaaccaggctcaagaccctgcctgccttgcttcagttctaactcctttcatttctttctcaggaaagcctgctggtcaacagtcagattatgctgtctcagagccggtttggataactatggcaaagcagaagcagaagagtttcaaggcccacatttctgtgaaagagctgaaaactaagagcaatgctggagccgatgctgagactaaggagcctaaatatgaggtaggacctggggtagccaataaaacactccaaaaaggttgctggaatcactgattaggtttctattgggaactttgccaacatgcagctccccctctctttgggaacattaatcaaggcaggaggactcttcagggaaaaagacttgctttgtatttatacaaacgtgccctgcttttatgctcttaaagggtttgtgcaggccaggtgcggtggctcttgtttataatcccagcactctaggaggccaaggcaggtggattgcttgagctcaggagttcaagaccaacttaggcaacatgctgaaactccatctttactaaaaatacaaaaacacagctgggtgtggtgtcatgtgctgacatcccagctactcaggaagctgaggtgggaggatcacttggagcccaggcatggaggctgtagtgagtcaagatcacgccactacactctagcctgggtgacagagtgagaccctgtctcaaaagtgtgtgtgcgggggtgttgtgcaaagtcatgaacatagagagaatctgcaaaacaaatcctgccctcaatattctaaagcaaggctccacgaaattggttgagaaataaggagtaagtcattttattttatttttaattttttatttccataggtttggggggaacaggtggtatttgtttacatgagtaagttatctggtggtgatttgtgagattttggtgcactgtaacccagttcatagtattttatccctcatccccttcccaccctttccctcagagtccccaaagtccattgtatcattcttatgcctttgcatcctcatagcttaaaaaaatacctaaaggtaatcactggggtaagagttgagtgactatctttacagatattttatacctatcaatatgtatatatatttttataaatggaatcaaacttaaatactgtttttttcatttaacattttatttctgggcacttttctgtatcagtacacaacaagttccctttctgtgtttgatgtttggatttctacatattgatttggtttggtgtggcacctacctgtaagttataaaatgtgatgtggtaaactaggctaactaccacatgtggataagagatgatgggatgatgcctttctcccctcttatcaaacctgcagaaaactgactcaaggaaacataccaaattcatatatcaagagatatgtctaagctcctatacttttaagtgcttactaaatttgttgaaggactgtgcgaggaggtgtttaactctttgctttaaaggtcttttctttttcatcattagtatttacatggggacaggaacatagaggggtaaagcccacctttattaaagctttttttttttttttttttttttttttttgagacaggttctcactctgtcttcctggctggagtgcagtggtgcaatcacagctcactgtagtgtcaacctcccaggctcaaacgatccttccccttcatccccgccatagtagctgcgactataggcactataggtgtgcgccaccatgcccaggtaatttttaaaattttttgtagagatgggtctcactgtgttgcccaggctggtcttgaactcctgggctcaagtgatcctcctgcctgagcctcacaaagtgttgggattataggccactgctctcagcctggttaaagcttttgtcaggagggatacattagtgtatataaactcattaatttagaccaattatgaagaggttaatttgaaaagaataaactgcagaattttggaaagacctacagttatattactttctaatgtgagaaatgcttcaagtcatatgtcagctagttttgaaaagtagaaatcttatggaactcacttcagtgaattgatcagatttgtttgcaactaccatgttctgttagcttgctgttaagtgctggtaaagtgctaaggaaaaggttgttctcaagttaaataattatcttgttaacctgctttcactatttgtaaaattagacagctctttctttctggtctgaaaggtggtaaacttgagccagcttaggttttgtgaacctaaattttaagccaaaaggctcaatgctatttctctccttatctatctctatatttctaatctctttccttttggatactgttaaactcatagtacccaggacagggcttgcactctatggtcctctgaataagcaatctgccattttaatgtcagaacttacaagctttctgttttcatttttgtattaaagggagctggctctgcaaatgaaaaccaacctaaaaagatgttcacttccagtgtccataaacaggagaagacagcacagatgaagccacctaagcctacaaaatcaggtaaaagcatacattctgacctctcaaaaaacagccccgacagaatgttgtaaaacttttgcaatttcaagctcagataatacttgtctcttaccttaagtcagcttaatgatttctcgcgtggctctttaattagatacaaatattagcttattttaggaaaatctaattattttgactaatacaagtccagtgtataactttcagagggtcttccagtcttttgcctcatcaaagaagctgtctaggcacaaaactgtggtcactcactgaaacattcttctggctgggtatgcaagaggaaagtaccaagtcactttccagttcatagcaaagcggtattttctcactttctacatctccaatgaaactgttgaaaataattcactctaaaggcccaatggtattcaattgtttttaattatttagaaggcttgtttaagcttctctgtattctgagcagggatgtgtaagtggtgaggaaatgttgacagctgagaggaatactctgctgggatataatagaatgtgatctcaccagaaagaattgtgtgctagagagaattttttcagcaggagcaggggagtggatgatggatttttattgaaccatctttgtcctctcccttaatcccgctcatgaagaaattagaccaggaattcaggaacccattttctggccatgaaatagcagcagttgacttgctcacagcttttaatggcctcatgggcactatactcctatcaagtgaatcacaactgtcactgtgcatcagaatcacctggtgagctttttaaaaaattacagatggtcctggctccatccttagagattctaattcatttgcttcaggaaacggcatgggctttggtgtttttaaaagagccctaggtgattctaatgtgtagccaggattgagaaccactggttgattctaagtcactaagtcaattgaccataagcaggatgagggagggagtggaattaggaatagggaggtagtctccttggctggggtagttgggttggtacaatattatttatcatcaacttttactgggtgcatctattaagtcatcaatcaattcatttcacatgaaatcgtggattggcaaacacaaataacattaccttatctgaaattttagaaactaagtagatacaatatgtttccctctggtctcagttcaaagatgtaagacaatccagtaataaccacctgaagattggcagttacagccataggtattacctcccaggccttcccatgcccagggccctgtggccatagccaagttgattttacccctttgacatactacccatggcatcacacaggtcctaacttttagaagtctggcaccaaagggagaagagtttagaaagcactagagcagggggatcagaggaaacctgaaaggaggaaacattatatggcattccataaacaacataccccaatatcgctggggttccttattgcttgtgtgttatttgctgtggttccagttggatttgaagctcagaagatactgcaagttcctgccatggaaaaagaaaccaaacgatcttcaactctcccagccaagttccagaacccagttgagccaattgagcctgtctggttctcactggccaggaagaaagccaaagcatggagccacatggcagaaatcacgcaataaagagctcttgtgtggagcatcagcatttattttatttagtttttttttttttttttttttttgagacagagtctcgctctgttacccagattggagtgcagtggcgcgatctccgctcactgcaagctccgcctcccgggttcacgccactctcccgcctcagtctcccgactagctgggactacaggcgcccgccatcacgcccggctaattttgttttcgtatttttagtagagacggggtttcaccatgttggccaggatggtcttgatctcctgacctcgtgatccgcccgcctcagcctcccaaaagctgggattacaggcgtgagccaccgcgcccggccaagcatcagcgttttaaatgataattgctaatagctgtattaattctatgtagtgatctttttactgtgaccacttgtattaagcaaaataagtattaagcaaactaagaatttattaagcaaaataagaatttattaagcaaaatagccttagaaatgcaaattaaaacataattatttgaatgaaataaatgccatgaatgcttaaccttccacgtagtcactgccagcacccagaaacccagcatttcctctattaaaactatcgaaaacatttgcactgctgtaaaattgcaaaatctttaactttggacaatgtgctttagaagggagaaagcaaaaacattttgttggagcaactagaaaattgtcatttccctcaaccaaataaagtaattctaatggaaacattcagatgatttgacctaaagattggcctttaggttttatgagcctagatagatgccgcaattatttggttgttgctctaagctttgcaagggatcctaaaagaggcggtggaagtgaaaattctgggtctccaagaaaatttctgcacagccagttctccaatcagcctatcaccccttgaaacatcttccctgtgtccctgggggcccctgatgctttctccttgggtgatagtaacatgcagagcacttacacaaagctccctctttggacataccccacgtcgacctgtcacaggcctggctgtagcgagcacctccctatgacgcagaatgcttcttgggaattatcttactcctctggagggttagtccatcaatgttttgcttcttgtcccaatactactgtgaccctctctgatcgcacagaaatcactgcctatcacatatatcctgttaagcactgaagaccctattgaaattagagttctacagatgccaaaagctgtactttccatcaggcagatggcaagcttactgccttgatgcacatctggagccactggagctccttcctctctggttccagcattaaggtggagaactccatgtagcttcttgtcctttcccctcagctgtctttgcttcacaaggttttagcccaaagcaagagtgcaatcccaaagccacagagaaatgaactttccgctacctggaagctttaagtgagtaaatcagcttttcccctctcattcctagaggcacacacctcaaaagttactaggctggagagaccctaccttccagtgacccactcatcccccagccacggagaagagggaagaccaaaaagggagagtgagaaagaggatgagagggatggtcagctgtgaggggagggggcaagtggcccagcaaatgttgatgcctcccttcccatcttgccacacggtctttttcttttgtagcacagcctccattaataactcctcggctgaggatgaagatgtaggcacctttacccccagagccagttccttaattggctggctttctgagatgcagaccaccctagaatctcatctaggttcactagaagttagttaaatcttcctttctctgtctttctcttcattccatcccccaaacccaccaaacactaagggagagctccctttggatgtctgggcagtaaacctagctcatttttctaggagacccagaagtgacttctgagtagttatcactgtgtctgcctctgttacactgtgctgctttgcttaaacagaaatgcaggcctggacatctgactgtgcctttatattctgagtggggtgctgccccatgcaaaaaaatccagagaggtagtgaggtgtcagagctaaacacttggtgctgggttttgttgatgctggtataatgtgacacagtacaattacatgctaaattttgcattttctctatataacatctatttttcctgatactgtgcctttgccattttgataatgctattttgattgagtgaattttatttcctttgtattcccatagtgaacaatatattaaggtagatgccctttatctgggtactcctggtagattagctgttacacctcccttcccttttttacagtgaacctgtattcagttattgtcactctgagaactctccaataacaatttcttttccacagttaacaacacagctgttacacctcccttcctttttttcacagtgaacctgtattcagctattctcactctgagaactctccaataacaatttcttttccacagttaacaacaaagttctgtttttaaatgaagagattaagttctttttaaatgcctaaaggcatattctgacaacttttctacttctttaacttttttgatttaagatatatgcaaagcaaataaattcaataaagcct

SEQ ID NO: 3661 - DNA, 71944 bp, human; identical to SEQ ID NO: 3660

SEQ ID NO: 3662 - DNA, 8140 bp, human
tccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgctttctataggcatgtaactgtcaaaatcatttgaaaaccacatacattatttgtcacttagagtagcacacatagttgctttatcaataaacataatcatgtaaatacctgttaatattgagctcaatattaaaggagtgaaaacatgtgcatgaggcatcatcatgactgtagtttgcagagtcattgagaggatgtcagcctgtgcacagagcacaaaactgggagtcaggcaacctgcgttctagtcctgattgggtcatgactagctgtgtgaccttgtgcaaagcattgttctctcagagccttagttttccctctgaaaagtgataaagatggcctattgtgagatctctgtctctatcttgcactgtcattcagtgagcccatgactacgtgacatcttggtagaaagtgatgcttcatgttgtaaaggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgcccagcagcaatggtgtctgcatttttaaaaagaaagtaaaaaggagatgcttgtttctggcttatgctatgggctgaggtctttggggagaaataggaatgaggggttaagttcagattttgagaattcaggaattggtttctgtcaaatctaactgtttaattgtcactctagcaatatttcactgccaagaatttgaataagagtctttcccagcttttatgaaacagtatataaagaccatgagcattatttgaagatttttcatttaaaatgtagttttctatgtgtgttctctataatcagttaaatattacatgttctcttggctatatccaaccattttctttgaaaataatgctgacttcagagagagttctggattaataattagccagatgtgtctctgcctttgagttttggtctcaagcaggctacatataacttccaagtctagaggcaagtttttatactttggaaaacatagttcagttacctaatagagtccctaatttttggcatcataaggatgcctttgtaattagttttctatatgaaaccagtgaattgtagtgtctaacttacaaagctctattttctagggcttgccttcatcagtgggagaaaaagtgtgattttttttttccactttaaggctagccccagatgctgttgtgacacctcagctacacttaaagttggtgtggattccccttaaggcaggtttcccaggagccacctggcttttatttgtctcacacagttccaattgttcccaacggttatttcacacaaaagcagctttagttacctggttagacaggttggttactcctctaattcctactcatattcaggaagaggagactcttggctttggacattcagatgatcgaccctgcattagtttggctacagtgatgaggtggtttgctgatgccatctcttctcaagtcttttgcattctggtttgcacccttacatctgttttctccaacacctccagtcatctcctggctcctttaccacttcctttaaccacccataggtttttctctgtgctgggaaaaacgttctgtctcttgctctcctcttcatctatgagactattattccttcctttcactgtcaaacaaacttcttacaagtttttattcctaaccactacttcatttcctctctataccttcttcctccctacaatatggcttctatccccacaattggattgaactctctttctgaaagattttcagggaaaccttttttttttttcttgccaatcctgacttcacttgtccattccatgttttagatctcctgtcatgtgagcctccagaatggctccctccacagagttcccattttggtccatgggagctccaattttcacttaattaattcatgcttccagttttctttcaaagtacttctcatctgtccctttccattcccctggacaccaccctgctcctggcgctggttcctttgcatctggatctgcactctgcctctggatcgccctgttcccagtctctccttactgaaatctgccctatacaccacattgataatatcgttgttaaagcactattttactgtgtcattccttcgcttataaaccttcagtgccctttgccacctataagtccaaactcaggctggcttttcagatctttcataatatttccccacactacttagccaatcttatctcctactaacttctaaatgttaactctactcctgccaacttggtctcttcattgcttcccagatacgttgtctcacctgtatgcatttgtacatggcgtttgcattttctggaactccctccctaaatccttctatacatttttccaaaatatatcctccttccatgaagtattctgtaacccttctgatgaactcatcacttgcccttgttcttctaaacattccttacacacaaacaattcattttgacgttaccttgcacactcattgccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccact

SEQ ID NO: 3663 - DNA, 8213 bp, human
agtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgctttctataggcatgtaactgtcaaaatcatttgaaaaccacatacattatttgtcacttagagtagcacacatagttgctttatcaataaacataatcatgtaaatacctgttaatattgagctcaatattaaaggagtgaaaacatgtgcatgaggcatcatcatgactgtagtttgcagagtcattgagaggatgtcagcctgtgcacagagcacaaaactgggagtcaggcaacctgcgttctagtcctgattgggtcatgactagctgtgtgaccttgtgcaaagcattgttctctcagagccttagttttccctctgaaaagtgataaagatggcctattgtgagatctctgtctctatcttgcactgtcattcagtgagcccatgactacgtgacatcttggtagaaagtgatgcttcatgttgtaaaggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgcccagcagcaatggtgtctgcatttttaaaaagaaagtaaaaaggagatgcttgtttctggcttatgctatgggctgaggtctttggggagaaataggaatgaggggttaagttcagattttgagaattcaggaattggtttctgtcaaatctaactgtttaattgtcactctagcaatatttcactgccaagaatttgaataagagtctttcccagcttttatgaaacagtatataaagaccatgagcattatttgaagatttttcatttaaaatgtagttttctatgtgtgttctctataatcagttaaatattacatgttctcttggctatatccaaccattttctttgaaaataatgctgacttcagagagagttctggattaataattagccagatgtgtctctgcctttgagttttggtctcaagcaggctacatataacttccaagtctagaggcaagtttttatactttggaaaacatagttcagttacctaatagagtccctaatttttggcatcataaggatgcctttgtaattagttttctatatgaaaccagtgaattgtagtgtctaacttacaaagctctattttctagggcttgccttcatcagtgggagaaaaagtgtgattttttttttccactttaaggctagccccagatgctgttgtgacacctcagctacacttaaagttggtgtggattccccttaaggcaggtttcccaggagccacctggcttttatttgtctcacacagttccaattgttcccaacggttatttcacacaaaagcagctttagttacctggttagacaggttggttactcctctaattcctactcatattcaggaagaggagactcttggctttggacattcagatgatcgaccctgcattagtttggctacagtgatgaggtggtttgctgatgccatctcttctcaagtcttttgcattctggtttgcacccttacatctgttttctccaacacctccagtcatctcctggctcctttaccacttcctttaaccacccataggtttttctctgtgctgggaaaaacgttctgtctcttgctctcctcttcatctatgagactattattccttcctttcactgtcaaacaaacttcttacaagtttttattcctaaccactacttcatttcctctctataccttcttcctccctacaatatggcttctatccccacaattggattgaactctctttctgaaagattttcagggaaaccttttttttttttcttgccaatcctgacttcacttgtccattccatgttttagatctcctgtcatgtgagcctccagaatggctccctccacagagttcccattttggtccatgggagctccaattttcacttaattaattcatgcttccagttttctttcaaagtacttctcatctgtccctttccattcccctggacaccaccctgctcctggcgctggttcctttgcatctggatctgcactctgcctctggatcgccctgttcccagtctctccttactgaaatctgccctatacaccacattgataatatcgttgttaaagcactattttactgtgtcattccttcgcttataaaccttcagtgccctttgccacctataagtccaaactcaggctggcttttcagatctttcataatatttccccacactacttagccaatcttatctcctactaacttctaaatgttaactctactcctgccaacttggtctcttcattgcttcccagatacgttgtctcacctgtatgcatttgtacatggcgtttgcattttctggaactccctccctaaatccttctatacatttttccaaaatatatcctccttccatgaagtattctgtaacccttctgatgaactcatcacttgcccttgttcttctaaacattccttacacacaaacaattcattttgacgttaccttgcacactcattgccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 3664 - DNA, 44081 bp, human
tgaaggtgtgcttgcttccccttcatattttgccatgattataagtttcctgaggcctacccagccatggctcctgtatagcctgcagaactgtgagtcaattaaatctcttttctttataaagtctcaggtagtttttttatagcaatgtgagaatggactaatacatactgacagcttgattgtaaaacttttggcctctagaactgtcagatagtaagtctgcattattttaagccactaaatttgtgttagtttattagagtggcaataggaaattaatacagacatgatggaaacttagaatgccaggtttgaaaaggctttctggcaaagcctcctgtctggcctgttgattcctggaagatgggagtgaaacagatccgaattcatagcatattttctttattgttcttgtggctcttggcatatgtttctctgtattaatattagttatcttcccattagatgtacgctacttgtgggcagattcagttagcatatagcacaggaccttgcccatctaacaggcaagcagcaatgatgctttgcaattgcataattttagctggagtttctaaaaggctttcacatatgaccctacaggcatcaacataaactgaaaatagaagggcaggaattatagaaggtgtcacagattggagagaggaagttcccagaagagactgtaaaagagacacttggagtgagaaagagaggaaaggggacaaatgccaaggaaaggaaatgagttttccttacccaggaaaaattggcgaaggctcacaacctttgactcttatcttgaaagcaagccaggaggcctatgcaggagtgagagaagccacaaatcactacatggcccgtggaagtagagcaggttggatcccagctgagggtcccatccagcatcctgacccccactcctatcctagccagtctgactggcaggaatgcaaaagggatgtttcctgcctgcctcaagagtttggtaactcttccattaggtagctggttagatctggaggagaaagctacataacccacttggggtttcagagggagccaaagtcaacttcttcagcacaatgccaggcaagctagacagatggcagcagaggagctatcagctcctgaatttcaaagaccagccaaggggagagacagagcttggccaccatggaaatagagaagcccaagaagataggggacccataattttcaggcctagtaattctcaatgtccatgtatagtccactcatgtgacttaatgtcttatgggcagtatttttcagtcaattatgccttgtaaaacaactctgggaagaggaactattctgtgaaattgctgggtcatatagtagttgcatgtttagttttttaagaaaccatagtcaggtgcagtggctcatgcctgtaatcccagcacttcgggagaccgaggcaggtggatcacttgaggacaggagttcgaaaccagcctgggcaatatggcaaaaccccatctctacaaaaaatacaaaacattagccagcatggtggcccatgcctgtggtcccagctacttgggaggctgaggtgggagaatcgattgagcccaggagtttgaggccgcagtgagccatgatcacaccacttcactccagcctgggtgacagagggagaccccaaaagaaagaaagaaggaaagaaagaaagaaagaaagaaagaaagaaagaaagaaagaaagaaagaaagaggaaagaaagaaactgccatactcccttccagtatgattgtatcattttacattccaaacaacaatgtacataagtgattccatctctccacacccttactagcatttgatgttgtctctaatattatttattctgacaaatacatagtgatacttcaatgtggttttaatttgcatttcccttacaatgaacatcattaactatgcttatttgctatctatatctcctcattcatggaatgactcttcatgacttttgttcattttctgattgaattgattggttttattttttaactgttaagtttttgggagttctttaaatattctgtatacaggtcctttgttggatatgtggtttgcaaatattttctccaagcttatagcttgccttttcatcctctttcgcaaagcagaagtttttcattttgattaagtccaatttataaatttttccttttatggctaatgcctttggtgtcaggtatgagaactattcacatagccctagatcccaaagattttctcctgtgtttttttttctaaaacctttatagttttgtgttttacacttaagttcataatccattttgagttgatttttgtgtaagatgtgatatataggtcaaggtgtttgtttgtttgtttgtttgttttttgcctgtggatatccaattgttttagcatcatttgttgaaaaagctatatttcctccattgacattcttttgtgcatttgtcaaaaatcagtttgccatatttgtttttaagagtctgtcctggattctctcttctgtccctccaatctgtgtttatccctccaccaataccacactatcttgactaccgtagcatcatattaagtcataacacaagtgattccatatactttaatcttattaacttattttcactacgttttaactattctagggcctgttgctttacatataaattttaaaataaacatgtctttgtctacaaaagttcttgctatgattctaataattattgcattaaacttgtatatcaatttggggagaattgatgtctttactgtgttcagttttccatccatggtatgtctctccatttatatagatctttgatttccttcatcagaattttgtagtcttcagcatacaagtgctttacatgttttgttagatttgcactgaagtattaaattttttagctattgtaaaagtattctatttttcatttcagtgtccacacattcattgttgatctagtatctgacagccttgctgaatgcatttattagttctaggtttttaaatgattcctgagatttactgtgtagacagttatgtcatttgcaaatagaggcagttttatttatgcctttctattttgtatgccttttatttccttttctcatcttattgcactgactaaaacttccagcactttgttgaataagagtggcagctgggcgtggtggctcatgcctgtaatcccaacactttgggaggccaaggcatgaggatcacttgaggccagaagttggagaccatcctgggcaacatagtgagaccttgtcttaaaaataaaataaaataaaagagtggcaagagagggcattcttgtcgtcagctataggtttttgtacttgccttttatcaagttgaggaatttccctctattcctagaaaactgagtatttttttattctgaatgggtgttgtattttctcaagtcacttttctgcatcaatttatgtgatcatgtaagttttcttcagtggccttttagtatcacagattacattgattgatttttgaatattgaactagctttgcatctctgaaataagcactattttgtcattatgcataataccttttatacattctgaattctatttgctaatatctttttttaaaaaatttatttttaattttgtggttatataataggtttatatatttatggggtacatgagatattgtgatacaggcatgccatgtgtaataatcacaccagggtaaaaggagcatccatcccctcaagcatttatcctttctttgtcttacaaacaacccaattattctcttttagttattttaaaatatacaattattgttgactgtagtcaccctattgtgctctcaaatactagatctcattcattctatctaattatctttttgtacccattaaccatcccctcttcccctccaacattacccttcccagcctctggtgatcatccttctactctctatctccatgagttcaattggtttaatttttagctcccacacataagtgagaacatgtgaggtttgtctctgtgtacctggcttattgcacttaacataatgtcctccagttccatccatgttgttgcaaatgacaggatctcatcctttcttatgactgaatattactccattgtgtataagcaccacattttctgtatccattcatctactgatggatacctaggttgtttccaaatcttggcttattgtgaatagtgctgcaataaacatgagagtgcagatatctctttgatatactgatttcctttcttctgggtatatacctagtagtgggactgttgaatcacatagaagttctatttttagttttttgaggaacctccatagtgattgtgctaattcacattcccaccaacagtgtacaatggttcccttttctccacatcattgccaatatttgttattgcctgtcttttgaataaaagccattttaactggaatggtatatcatctcaccccagttttgatttgcatttctctgatgatcagtgatgttcagcactgtttcatgtacctgcttgccatttgtatgtcttcttttgatgtttattcagatcttttgcccgttttaaaatcagattattagatttttttttcctatagagttgtttgagccccttgtatattctggttattaatcccttttagataaatagtttgcaaatatattctcattctgtgggttatttcttcactttgttgtttcctttgccaggcagaagcttttaacttggtgtgatcccatttgtccatttttgctttggttgcctgtgcttgcggggtattactcaagaaatctttgcctagtccaatgtcctggagagtttccccgatgttttcttgtagtagtttcatagtttgaggtcttatatttaagcctttaatcccttttgttttttcatatggtgagagataggactctagtttcattcttctgcatatggatatccagtgttctcagcacaatttattgaagagactgccctttccctagcgtacgttcttggcaactttgtaaaaaatgagttcagtgtagatgtgtggatttgtttctgggttaaacaaattttcaagagaaaaacaacctcattgaaaagtgggcaaaggacatgaacagatgctttacagaagaagacatacatgcggccaacaagaatatgaaaaaaatctcaatatcactgatcattagagaaatgcaaatcaaaatcacaatgagataccatctcatgccagtcaaaatggctattactaaaaagtcaaaaaataacaggtgctggcaaggttgtggagaaaagggaacactcatacatttgttggtgggagtgtaaactagttcaaccattgtgaaaagtatcctggagatttctcaaagaactaaaacagaactaccatttgatccagcaatcacattactggtatatacccagaggaatacaaatcattctaccataaagacacatgcacacaaatgttcattgcagcactattcacaatagcaaagacatggaatcaacctaaaggcccatcattggcagactggattaagaaaatgtggtacatatacaccgtggaatactatgcagccataaaaaaagaacagtatcatgtcttttgtgggaacatggatggagctggaagctattattcttagcgaactaacgtaggaacagaaaaccaaatactacatgttcccacttattagtgggagctaaatgatgagaactcatgaaaacaaagaagggaacaacagacactgggtgctccttgagagtggaggttgggaggatggagaggaacagaagagataactattgggtactggatttaatacctgtgtgattaaataatctctacaacaaacccccatgacacaagtttacctatgtaaaaaaccttcacatgtacccctaaacctaaaataaaagttaaaaacagaatatatcattattaactatagtcatcacatcgtgcaatagatctcttgaatttattcctcttatctaactgaaattttgtatcctttgaccaacatcttcctcaaccccttcactgcccccagtccctggtaaccaccattttattctctacttctatgtgttcaaatgtttaagattccacatataagtgagatcacatggtctttgtctttctgtgcctggcttatttcacttaacatgttttccagttttacccatgttgtcacaaatgacacgatttccttcctttttaaggcggaatagtatttcgttgtgtacgtataccacattttctttatccattcatctgttgttgaactcttagattatttccatatcttggctattgtaaataatgctgcaatgaacataggagtgcagatatctcttcaatacactaattgtattttctttgggtatatacccagtagtgggatggctagatcatatggtaaaaattttacttttaattcttcgaaaaatctccatactgttttcaataatagctgtactaatttacattcccattaacaatgtacacgggttccctttctccacatcctcacaaacacttgttttttgttttttgttttgtctttttgataatagccattctaacaggtgtgaggtaatagcacattgtggttttaatttgcatttctctgacaattagtgatgcttagcatttttcatatacctgttcatcatttgcatgttttcttttgagaaacatctattgaggtcctttgcccaggttttttgtattcctgtatttttgtattctttaatcaggttatttgtattcttgctgctgagttattttagtttctcatatattttggctattaaccccttataggacatacgctttgcaaatgttttctctcattacatacattatcttttcactctgtttattgtttcctttgctgtacaggagcttttcggtttgatgtaatcccatttgcctatcttcacttttattgcctatgtttttcaggtcatatgcaaaaataattgcctagaccaatgtcatggttatttcccctgttttcttctagtagtttcatagtatcagttcttacatttaacactttactccattctgagttgattttgtatatagcgtgagacaaggatctaatttcattcttttgtacataaataattgttcaaacaccaattattaaagagactctcctttcctgctttccccattatgcttttccccatttcccccattgtatgttcttagcacctttgtcaaaatcaattgaccataaatgggtggatttatttcagggctccgtattctgttctattggtctatgtgtctgtttctatgccagtatcacgctgttttgattactatcgctatatagtagattttgaagtgaggtagtgtgatgcctccaggtttgttctttttcaagattgttttggcagtttggggtcttgtggtttcatacaaattttaggattgctttttctattttagtgaaaaatgtctgaaattttgatagacatttcactgaatcaatagattgctttgggtagtatagatattttaacaatattaattttccaacctgtgaacatggaatatctttccatttatttgtgtctttttccatttcttttattaaaattttatagtttttggtatacaggtttttcacgtccttagttagatttattcctaagtattttttgtagctattgtaaatggaattattttcttgatttctttattggatagtttgctgttagtatatagaaatactaccgaatttttgtatgttgattttgcatcctacaactttgctgaacttatttgttctaacaggattttttggcagaatctttagggttttctacacataagatcatgtcatctacaaacagggacaatttcatttaacttcttcctttctaatttggatgtctttctttctcttgcctaattgctctaactagggtgtccagtgctatgctgaatagaagtgataaaagtagtcattcttgtcttgtttctaatcttagtggaagagcttttaacttgccactattgagtatgatgttacctgtgggtttgtcattcatggcttttattatgttgaagtacatttcttctatatctaattttccagagtttttttaatcatgaaaggatgttttcaagcaattttgttaaatgcttttctgaatctattgagatatcatatggtttttgcgcttcattctgttaatgtagtgtaccacatttataggtttgtgtatgttgaactatccttgcatccctggaataaatcccactgatcatggtaatgatcgatttctcatcgagccttagctaccttcccgcggggcagggctcgggacctgcagcccgccatgcctgagcctcccacccactccatgggctcctgtgcggcccgagcctccccaacgagcaccgccccctgctgcagggcgcccagtcccattgaccacccaagggctgaggagtgcgagcacacggcgtgggactggcaggccgctccacctgcagccctggtgcgggatccactaggtgaagccagctgggctcctgagtctggtggggatgtggagagtctttatatctagctcagggattgtaaatacaccaatcagcaccctgtgtttagctcaaggtttgtgagtgcaccaatcaacactctgtatgtagctgctctggtggggccttggagaacctttatgtctagctcagggattgtaaatacaccaatgggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaaactctgtatctaactaatctgatggggacgtggagaacctttgtatctagctcagggattgtaaacgcaccaatcagcgccctgacaaaacaggccactgggctctaccaatcagcaggatgtgggtggggccagataagagaataaaagcaggctgccctagccagcattggcaacccgctccggtcctcttccacactgtggaagctttgttcttttgctctttgcaataaatcttgctactgctcactttttgggtccacgttgcttttatgagctataacagtcacctcgaagatctgcagcagcttcactcctgagcccagcgagatcacgagcccaccgggagtaaggaacgactccagatgctctgccttaagagctgtaacactcactgtgaaggtctgcagcttcactcctgagcccagcgatatcacgagcccaccgggaggaatgaacaactccagacgctctgccttaagagctgtaacactcactgcaaaggtctgcagcttcactcctgagccagtgagaccacgaacccaccaaaaggaagaaactccgaacacatctgaacatcagaagggacagactccagacgcgccaccttaagagctgtaacactcacggccagggtccgcggcttcattcttgaagtcagtgagaccaagaacccaccaattccggacacagtagtgaaagtccaggttacacccttggcctcctttcatacctgaagggggctgttgagtgggggtaggagttccagctccccactcagggtccactgatacctggccgagaggtacaggaaggcttcttaatggtctccatgtgggttctactgacataagtggaggaggctcttttactcccaggaagtggctaaagtcctgactctcttccaagcctcctctgacagcaccaggcaggagggttaggaggccttcttatataaccttgtgtgggtggaagtctaggcttcccactaggcctttgctggcatggataagggtgttgctgcaatggtctattgggctagagaaaacattttccttggggcctttttttatctctactcattggcagttctgaattgccagcctctgcagttctgggtcgctgccttctttagcccaagtctaggatatatgaggcaaaaaaaataaaaataaccacccaagaaactcaccaccatatcatttcttgggtcccaagatccttaggcggtctgccttctcttcacctttcagagccttcttatgtttgttttatatacaatgacgagtttttagttatacttagtgaaaaaatagcaaaagttatgtgtactccactttcccaaaagcagaagtccgagactttaaaaaataattaattcaaaggatagagatcaaaggtaaaaatattttcacactcttagtctcattcaaatcaagaaaatgggtagcctcaaggtgtggggctctgtctctaaggaaatattacccttggctttactatcctttaagcaatagggaaactatgcacttttaaaagagccccttgtgttttgagctgcttgtgttcattcttattcatcaagtatttttttttttcaaagtgagctccgcagagtaccttcctcagcattatcttgaaataatttaagacatagaataccatgtcctgatctagacctgctgaattagagcccaggattggagattaggaacctatattttaacaatcatctcctgcccccaaggtatgagaacctctgatttaagccattgataaaatttctgaaggagatcaggccaataataaagacttgtaacaggcctggagactgtccttgagaagctattaatcatttatcaggacccttggggcagacttggtcaaccagctactaaacccccttattattctcacagcgagtccttattgtgctgctttgcaaatatcatgaaaatcctcaggtagtgctttgccaaatttcacttgttttatctgctgcattgccctgaccgatcattctagtaaacctattaaagatcatgaaactaggccgggcacagtggctcacgcctgtaatcccagcactttgggaggccaaggagggtggatcacgagatcaggagatcgagaccatcctggctaacacagtgaaactctgtctctactaaaaatacaaaaaattagccaggtgtggtggcaggtgcctgtagtcccagctactcaggaggctgaggcaggagaatggcttgaacccaggaggcggaggttgcagtgagccgagatcgagccattgcactccaacctgggtgacagagcgagactccatctcaaaaaaaaaaaaaattaaaaaataataaaaaataataatgaaactagtctgacaggtttcattcccagtgaaattacactgggtccagtgaacataaaccatccttttaaaataatccactttagattgtctcctggaatcaacaacaagcttgttctgtccatttacacttcctctattatttcctttttgaaatccatgatcacatttgcctgtctttaggcttctacgacccccctgcatatgctccaaattgatgaaaataaaattatccccaagggtggtttagaggtctcatttgctagttcttccaatattctgagagatataatttgtccagacaactgaacttggttaaagcaatgaaatactctttgacaaccattttacataccctggacttttcttcttttatcaatatttggtctaaactcttgttattcaaagtatggttcgaggaccaacagtagcattacctgggagcctgttagaagtgcaaattattgggccccacccagacctaccaaaccacaatctcattttaacaaaattcctaagtgatgtataagtgtgttaaagtttgaaaagcattgggctagactgttcagtatgtaaatttctccttgacaaaaaatataggtgcaaagtgagaacagaggagttctgctctatctttatcatccatcagtatgtcaatatcaattggacccctttctcaattgtcttctggctcttaacacaactttgtaataattatttatgtaactttgtaaaaattctttatgttgctcttatcatttcttgaaagcctcaggtctacatctggtgtttagccttctggacactgtttatgtaggtctacaccagtctcctgcatttattattggttttgtgggggtcctttccaaatttaacctgctaagaactaaaagtttctttttctcttttctttttttttttttttttttgagacagagttgcccaggctggagtgcaacagtgtgatcttggcccactgcaacttccacctcccgggttcaagcgattctcctgcctcagcctcctgagtagctgggattacgggcatgagccaccacgcccgactaattttgtatttttagtagagacggagtttcatcatgttggtcaggctggtcttgaactcctgacctcaggtgatccacccgcctcggcctcccaaagtgctgggattacaggtgtgggccactgcacccggcccataccatatttctgggagtcccaccatgtttctcctatgctgttccagtttcaacttctccatgtcttctacctgcaaggttacctgtagaaatctaactgcttcgtgtccgtcatgaaatgccaatgtacatgctaacagtgctttctatcacttctcccaaagctttcaatctttgagatccccaaatggttttggattagaagggtgtcctccccagctctgtgccatactctgtcactgaggctttgaaacaactcagcttttgctcagtctcttaaaatctcccttaggcagggccagcaatttattatgttcattcatttaatcatggaagttaaaggtccggaaagggaattgatgccatattatccccttggagctcttcttatcctcttctagcccttctcatcaccaaaagctcttgtcttatctcatggttacaaagcaaatgaccccacatatataagtgaatgcaaatagacactgatgtgtgtttaggaaacaggaggaaagaagagactgtatactttagtagtgactggattccagttcagtccatcaaatgtgcacagttatcactgcatttgattaatttttaaacatttagggaatttcccagatatctttcttttttgttgtggttttttttgtttcacttttgtttttcccagatatctttctaagtattaatttctactttaattcctttatggttagtaagcatatcttttattatttttatcattttatattttttgatacttcctttacagcccagcatatggtttctcatggtgagtgtttttcatgcacttgaaaagaatgtcttctgttgttttgggagagtggggaggagtgaactataaatgtcaattaggacaagttgattgatggtgtcttaatgactgttaacttgttcaactgattactgagcaaggagtgttaaagtctccaaatataattgtgaatttgtctatttctcctttaaattataccagactttgcttcaaaagttttgcagctctgttaccaggtacacacacttagaattttgtcttcttacgaatgaaccattttatcagtatgaaatatccctctgtatctctggtagtcctcatgtcttaaagtctactttatctcatgataatattgtcagtagatttcttatgattagtatgtgcatagtatatttttccttctttttactttaacctgtctttatatttacagtaggtttcttatcggcagcctgaacaacttatgccttcatttggggtgtttcctatgtttaatgtaatcattgatatggctgtttctaagtcttccatcttggtattttttttccatttgtcccatattttccttgttctttttttcctcctcttctcccttccttgacattacttgaatatttttagtagtctattttggctttttagccatatttcttatttgatttttttatttttagtagtagtattttatgaattaaagggttaattcatacgaagacagaattcttaaagtgtatgtacctgataacaaagctgcaaaacatttgaagcaaaaactggtagcatttaaaggaggaatagacaaatccacaattatatttggagacagtaacgctcctttctcagtaatcaatacaagttgatagtcattaagacaccatcaatcaacttgtcctaatctggggattacaatatgcatccataacttactacagcgtacttttttttttttgagatagggtctctgtctgtcacgcaggctggagtgtagcagcgctatctcagctcactgcaacctctgcctcctaggctcaagcaattctcccatctcagcctcccaagtagctgggacttcaggtttgaaccaccatgccagactaatttttgcattattggtaaatgcgaggttttgccatgttccccaggctggtctctaactcctggctcaagcactccacgcatctcggcctcccaaagttctgagattacaggcatgagccactgcacttggccaataacttattacagtgtactttgaattaatattgtaccaattcacacatataatgtaaaaaccttataacagtatatttccttttactcctcccttttccagtgtactatagtttttatgcatatttacttctatatagtttatagatcccataatacattgttagtctttttgctttacatagtccattgtcttttctagtacattaagaaattcaaaaaacaagtttttaaatatttactcaagtgtttaccattttcatttctacatgtagctttgaatttccagctggcataatttccctcaagcctgcagaatttcctttaacgtttctcatagagcaagtcagcttgggatgaattataattgattctcattatttggggatctataaagtcatcacacacactgagttaagaaatactgaaccactgatcctaggggaaatacagtaggttcatacaagcctctggtcacaacagtttcatcaactgatcaatatgtagccgtgtgttatatgtgtttctgtttgaagatatcttctatattagatactgttgattcattgacatttaactcatggccaatggtattttaatttatgcttgaacaaaacttaaataacacatttttttttccattaggcatatcacagccttgttgcacttaggaatgctaaacatcacttcagtactacattttgggaccgtttaagatagtgaaattactaataaaaatgtggaaaatgtgacactaaatagaccatggaaatgacacttttttacagtatgagaactgaagcaagaaggcagaacattgcattgtttggcctcagctgggaacatgcactttaggcaattcaaattttttgctgctctccatgtgtccctgaaagctggtgaaagtaccatgagaattgatttggggttacaaataaattgtagcaagtaggtgaatttgcaaataaataatttgaataataacaattgactatatcttatctttctggaatgttttgtcttcctttaaagagtgttgagctttggggggacattgaatttttttctggcaggctattacttatctaatgtctaaaaatatttgttctatatattttatttatatttatttacagcaagaaggtaaatctgatgctcatttctccatcatggttaaatcatccctgcatttggagggtgtgatggttaatactgagcgtcaacttgattggattgaagcatgcaaaatattgttcctgagtgtgtctgtgagggtgttgccaaaggagatgaatatttgagtcagtgaacagggagaggcagacccactcttaatctgggtgggcgccttctaatcagctgccagcatggctagaataaagcaggcaggagaaggtagaagagtagacttgctgagtcttccggccttcatctttctcccgtgttggatgcttcctgccctcgaacatcagactcagcttttgggctcttggacttcagcttttgggctcttggacttataccagtgatttgccaggggctcttgggcctttggccacagactgaaggcttcactacttttaagattttgagactccgactggcttccttgctcttcagcttgcagacggcctatcgtgggacttcacctcgtgatcgtgcgagtcaattctcctaataaactccccttcatatatacatctatcctattagtcctgtccctctagagaaccctgcctgactaatacagaaggaaaggcataaatgaagtagtcactcatctcccaatagctgttgtgcgtatgtagatgaaaaggagtacagagttacctatgcaaaatgtggtcattgtataaagaacgacttttcaacactgtgctaggggttatgagaaataaaagagaaggcaaaacccagctcttattcctaaggactttaagtttcagttggaaggcaagttgtcatatgtgaaatgtcaatgtttatcttacttcaacccctaccccactggtcctaaccctgttcctctgtgagtcttccccagaaaatacttacggagatgtcttcaggctgaggagccaaggaaaatttctttgggtattgtacaccataccctcaaattgttctattgtacttaggtcctacgtttaccatttagagctaccaactcattctgctttgagtggaacgttccagaaaaagccttgtttcaggaaccccatcagtcctgggaaaccagaatggttggctatctgagcccatattgctcacagcattgccagtgccagcctgggtgaccaagtgagaccctgtctcaaaaacaaaaacaaaaacaaaaaaagttcctgagagtttcatacattttttggtgatatcagcatgcaaataagatccacatatcacaattggttgatacgtcttttaagtctcttttcatctataggttcctccactatttctttttttttcccattagaattgattagtaaagatactagttaatttttcctatagagtttcccactgtctatggattttgctgattgcatcctagtaatatatttcaagtaaactggtagttagatctaggggcttgttcagattcaggtttgattttttagcaagacagcttcataagtggtgctgtgtactttcatcagaggtacataatatctggttgtctctcttcttatgatgctggcagccattgatgaccattgcctagtccactatttcattaggaattgtcaaattgttaccagggggtccttgctcccagagctcccaagatggtggcaagcctcgcgttctctgacctggggttcttgacctcatggattccaaggaatggaatcttgggccatgcagtgagtgttatagctctattagaagccgtgggtcatggaagagaaccatggaacccagtgactagtgttcagctccatcaggatgaaacccgggcacttagccgtgcaggaacaatggcaagcctttagcctgatcgggagcggcaatgggcaccttgctggatcaggagcacagtggacaccctgctggatccggagggatggaagtcagtggcgggtctgcaacggcggcaaacaccagtggtggatggcgagcgaaagctcagctgtagccataagaaacatggaccaaaagagagtgcagttgcaagatttaatagagtgaagacagagctcccatacaaaggcagggggcccaaaaagggtagccgttgcaggctcaaatgcctgggtttatatcctgatccttgtccctcccgctgtgctctcaggcaacagatgattggctatttctttacctcctgtttttgcctaattagcattttagcgagctctctttactatctgattggtcgggtgtgagccaagttgcaagccccgtgtttaaaggtggatgcagtcacattcccagctaggcttagggattcttagtcggcctaggaaatccagctagtcctgtctctcaaaatggcaatattctatcattctttcttcacccattaactggaatactcctatgaaaagaaactccccatcaacaaattttttactaccccgtggtacaattgtatagaaaagacttcagtgacaactttgctgatagatctccatatgcacctgtgaaaggaaaataaatcttgggaccccaaaatcactaagctaaaggaaaaagtcaagctgggaactgcttagggcaaatctgcctgccattctattcaaagtcacccctctgctcactgagagagatgcatatctgattgtctcctttggagaggctaatgagaaactcacaagaatgcaaccgtttgtctcttatttacctatgacctggaagctccctccccacttcaagttgtcccgcctttctggaccaaaccacaaactaatgttcatcttacatatgttgattgatgtctcatgtctccctaaatgtataaaatcaaactgtgctctgactaccttgtgcacatgtcatcaggtcctcctgaggctgtgtcacgggcacatgaccccaaccttgccaaagtaaactttctaaattatctgagacctatctcagatattcagtgttcaaatttcggtaaccacaaagggattctgagtggaggtacccctgaactttgacaaatctcatattggtgcttggtaccagcatgagcaactttgtggctcaaaccaataggacaatttgctgaggtctgggagcaccccctccagagaatccctgatatccctaaatttggtagagatctaaagtttattttgctgtacaactcccttttttttggagttttacttgcttctaacacggaaggcaagattccctgcttccatgacgatggaaagcaagtacctcctttatggagtttgagctcactcccaacaagaaagacgagtttgagtttttttcctgcttcaaggatagtagaaagcagtcttcaacctgagacccattcctaggtaagttaacaaccagctggttttaatttctccttaccattagagtgctcagtgatcatattgtcggggttttttgttgttgtttgtcctggtctttctcccatcagatttgaccaactccacctgacttggtcaaatccgagtgagaattccaaattatggataacaaagcctctctagtttggcaaaaattcctcgcagctgcaaaagaggaaaaaacaaaaaaagccatgcgcttggattttgtgtttgcttcctgtcttaaaaaacaaatgttctttcgtttacttttcttccactctatacctccttccccctatgccatctgcagtaccaaaaaatctagagaaggcttccaatgacttgagcccctttcaagaaatcagaacaaagataccactcaccccttttggagtgttctgttttccttgtggagttccaagagtcatggacagatttttcttaggtctaaagctctgttttcctgtattgcatgacctgacctttttggctttgggagtaccagaaataaccttgtactatgagagaacttgacctcggcatgtgtaatggcagacgagagctacaaaattaggggtggctgagcacagtttacaggaagtggtcttcactgttgttgttgttgtttccctcctaggaaactgttatttaaggatcttaattctagttcagagatgtattctaaagggccttctctattgctttttctcccaaaattaatctcgattcagcttgtctgtgcgcatttgcgtgaggaactgaactgttgttttcatagataaatgagggactgagttttctcagctctgaagagaaagggcattttgatcctcccagccaaaaggcactccagggtgtatttcctggataagccttttttttaaattaatttttgttggggatttccctgtagggccactgaacgtttcgaggggtcaatcccccagacattcccacatggcccccagtcaaatcagctgttatttttctattaagataaaaaccactgtttggatccaacacggtttttttttgcaagctggtgaatttgtatttacctcatggctaaggttctgaagtaaaagcgataggatctttgtgtgtgtgtgtgtgtgtgtgtgtgtgtgtgtgtgtgtgtgtgtgtgtgtgtgtgtgtattttaaaggcctttataatttttataattttatgtttaattggcaattaaatccgttttaatttccctctagcacaccaaagtatttatctccataccttatgatgtatatcttgctatttgattttcacctgacttgtttcctttaatatgcaaatttaagcctatttagctgacaactgcctagggtagtgaaacaggttatgaagaatttgaaagcccaagatagggaaaaataaaaggtttttatgactctataagatgtacattctatcagcatgcctaatacgtctatgtatttatgtacccaatgtttcactactgaaaatatatgcaagagctctaattaattggcttaagaaaataaaagcacttgaatcaaatactttatcaggaaaaaacaaaagactagtcaaatgctttttcaagtttacataacttaagtaaaatcttcaataaataagctagctttaaaattattggtaaagtaatattaaaaatgtcttaagaattgccagcatacatttttgtttgcatttattaatcaagcaatttcatacttatccctgccaaatactacaaggtgtcaaaatttggcataggggttacaaaaccataaacctagcccaaaacagaatgatctttgtcatgtaatctttaataaataagacattgatattagtttaatgaaaatagcaacatcttgaatttagtaagattgccataacttctaatcttctggctttatgcagtccagcccacaggcagtaaggtttgttttcagaagggactgttaccatctttgtctcaaagtcaaactgtaaattgaattcctcccaaacttagtttggcctgtgctcaggaatgaacaaggacagcttggaggttaggagcaagatggagtcagttaggtcagatcttttcaactgtctcagttataattttgcaatggcggttccataactttaaatgatgactgccgcagttttcataaataatctaggtaaacaattgaaataattaggtagacgtaatgggatgaatacttgtagacaacaaactcatcataatttagactctaaagttatattaaattaaataatagatatttaaaatattaaaagtacaaaaattagccaggtgtggtctcgtgcacctgtaatcccagctacttgggaggccgaggtgggagaattgctcgaacctgggaggcagaggttgcagtaagccaagattgcatcactgcactccagcccggacgacaaagcaagaccctatctcaaaaaaaaaaaaagaaaagaggatttattaaaaaaaaaactttcatatgatcaagttgtctattaattaaagggaaattataatggtctttctagagattgggcttgatgtaagaaaaaaccacttacacactaaataattggttagaataatgaaattttcttaagggattgatttactcttaataaattatgagagattttaattttttaacccaaagttcaatttgtattgcatcttgccatttttggttttctctccccttttaaagggcaagaaatagtaatgctctccaactcatttttcaactcatataagtttttctccttgagttttgtttgttgtggcctgatgctaacaatgttttcttaaaagtctaaaggaaattctttcttccaacataatattctgtgcagtgccgaaggtcttttcttttgccttttggtaactggcctaacagattttatggtttattgaaacaattcctatgctattattattaagttttggtttacttagggaaaaaaatgaaataaaaaaaattttttcattaaggttattatattcatgtatctttctgtatgggcttgtaaagtcattgtgacatagagttacagggctttggctcctggatctaaaaaggacaccaagtcctccgaaatcttaaacgctgacagcaattaaagcctcatcttcaggcccagtagagatgccaatcaaaataaactgcattcctgagacacaggccagaaattaaagctatctaactcctcaaggccagggactattgcagaagaggtgggcatgagattgtaagggccaatgttgagagataaaataagttcagtttctctatgaattaatcattaatgtcgaaggcacactgatggaagaccagcatatgggcccctgtgtcagattaataagtttttcttgaagcattaaccaactccttaataaaggttataaagattataaaaggcttattgaagttatatcttatgctcaagattaaaattttatagattgtttataaaattttgaaaaacaaatttaattggcgtcatgctgtttttattagggcttattgtttggaaaataaagtctcctctctcaaagaatgaaggattttgtctttttttgaaatccttgagttaccagtttggtgaaatgaatggcttattttacaatgatctgtgatatcaagtgttttaaacctttgatatttgacaccttccaaaatcaaattataaattatgtctttttctgatctaattaatcctttaagatattaggttccccaaagtccaaaaatgacataatttggcctatttcatataaacatcatacaggaaacattgtcaagtgtgaaatggtgtttggttttctttgagctgtatctatataaatatgttattggtatgtgttccaaaattatgggaaagtcctataattctgatatgacttactgtacataatcagtaataattataattgttttcttaaattattgtgtgccacagaggcaacaaatttccttgtccattgtgtctttgactatggctgccctaaaacttttttcatccatggacaatttttgtcttgttttcgtcctctttagaaggtagttttataatcagctataaaattctaacaggtgctcttgaatacaagtttctgaaaatttttgagattgtgacatcagaataaaagaaaaattttcaggactcatggagaactgaaatgttcatgaatatcaagcagaacaggaattaactacatggactgacatgcataagtacaataagaatctgttttcatttataacaggacacaatttgagaaactggttattttaccaaagctttgactggaatggtgtgctttcctttaaggaatcaaacttgacttatggagccaataaaagtcccatgggaaaactggccttataccttgtctacacagtccctgtacagggttcctgacatgtggtaagtaaagaatgccactttctgacaggtgcaggagccctaagtttatcttggaacctcaagaggggaggaattcacccaattcatagagtggtttttttgtttgtttgttttttggcataatctcgatctgttgcccaggctggagtacagtggtgtgatctcagctcactgcaacctctgcttcccaggtccaactgattcacctgtctcagcttcccaagtagctggaattacaggcatgtgccacaacaccctgctaaatttttttgtattttgtagagacaggatttcaccatgttggccaggctggtctcgaactcctgacctcaagtgatccacctgcattgaccccccccaaattgctgggattacaggcatcagccactgtgcctggccccaactcatagatatttgatggtacaaatctatggctgggcttggctttaaaaaagtcttatctgagattctttctatggaacaaagttccatcaatgccaatttaaaagcctatgtaaaaaataataattcttgctgcactgtatacaaataatcaggccaagtataataaagcaaatcagtccttccatgatttgtctttagtaaagatggaaaactggagagagaaaaattatgtttcaaaaactataatacacctgttgttagattccagtcttgcctaatgtttttcagttgtttttttttttttttttttttttttttagatggagtcttgctctgttgcccaggctggagtgcagtggtgcgatctcggctcactgcaagctctgcctcctggattcacgccattctcctgccttagcctcctgagtacctgggactacaggcacccaccaccacgcccagctaattttttgtatttttagtagagacggggtttcaccgtgttagacaggatggtctcgatctcctgacctcatgatctgcccgcctcggcttcccaaaatgctgggattacaggcatgagccaccgcgcccggccttttcagtttttattattttctacagtctggaccaaattctattttttcttggttacaagtcttcaagataatgttttcaatttttttccttcttttttcccccatttttcctaattaggagtcattgaaaactaagcgtgctttcataaagccctgtgaactgaagtcagacaacttaaactttagaagaaaataacagcaacccatttacatacataaaccactttcaaacctgcctactgattatggacttcagagtaatatggcttataccaattttccaggattgttcttttgtttgttgttgttgtttgtttgttttttgtttttttgagacggagtttcactctgccgcccagactggagtgcagtggcgcaatctcagctcactgctgcctctgctcctgggttcaagcaattctcctgcctcagcctcctgagtaactaggactactagttactagttagttgtcgtaattactaatgcccggctaattttttgtgtttttaatagagacagggtttcaccatgttgtccaggctggtgttgaactcctgacctcagatgatctgcccgcctcggcctcccaaagtgctggtattacaggcgtgagctaccacacccagcctgttgttgtttttctccctattttcacttcctaggatgtgaaacttcacaacctgctaaaaatgaactttcctaataattcaggacctaaccatctagaaataaaccaaccgagccataagagatcagacgaaacctgagaccagagactcattttcttctgaaatgctttctccaaaagatttttaaaaagaaaagggggggaatgtgaaaggaaataaatcttgggaccccaaaatcactaagctaaagggagaagtcaagctgggaactgcttagggcaaacctacctcccattctattcaaagtcacccttctgctcaccgagatgaatgcatatctgattccctcctttggagaggctcatcagaaactcaaaagaatgcaaccatttgtctcttatctacctaggatctggaagccccctcaccacttcaagttgtcccactttttcttcgagttgttgtccccgctttctggaccaaaccaatgttcatcctacatatgatgattgatgtctcatgcctccctaaaatgtataaaaccaaactgcactctgaccaccttgggcacatgtcatcaggacctcctgaggctgtgtcatgggtacatgtcctcaaccttggcaaaataaaatttctaaattaaccgagacctgtctcagatatttggggttcacataactcaggctttagcttccagtgtttaaaaccacaccttgagtcttcctttccaaagcatgccttccatgctagtgtgtctggatccagcctcaataacagcaaaatttgagagaaaagcttaaaaatatataaaatatccatgtaggaggcctaacatccattcatatgaaattccagaaagaaagcaaaaacaagagagggaaagaggtaattttaaaaacagaaaaaaatgtctcataactgaagaaagatctcagtttgaaagatcactgagtgggaattaggatgaaagaaaaagcctcacacctaaacacagcctcatgaaactctaaaatatcaagaataaagggatgatacttaaggcttctagaaaaagggaaaaaatgatgtacaaagaaatggaaatcttcattagcagcaatagatgtaaacaaagcaaagcaaaacaaacaaaataattttcactcgtgtccgtgcgaagagaccaccaaacaggctttgtgtgagcaacatggctgttgatttcacctgggcgcaggcgggctgagtccgaaaagagagtcaggaaagggagaaagggagataggggtggggccgttttataggatttgggaaggtaatggaaaattacagtcaaagggggttgttctctggtgggcaggggcgggggtcacaaggtgcttagtgggggagtttctgagccaggagaaggaaattcacagggttaatcactcagttaagatggggcaggaacaaatcacaatggtggaatgtcatcagttaaggcggggcagggccttttcacttcttttgtgattcttcagttacttcaggccatctgggcgtatatgtgcaagtcacaggggatgcgatggcttggcttgggctcagaggcctgacattcctgccttcttatattaataataaaaataaaacaaaatagtgttgaagtgttggggcggtgaaaacttttggggcttggtatggagagagaatgggcgatgtttctcagggctgcttcaagcgggattaggggcggcgtgggaacctagagtgggagagattaagctgaagggaggtcctgtggtaaggggtgatattgtggggatgttagaagaaacatttgtcgtatagaatgattggtgatggcctggatacagttttagatgaattgagaaactaaatggaataagagaaggagaaaaacaggtataaaaggtctaagaattgggaggacctaggacatctgattagagagtgcctaaggagattcagcatagtcccgccagcaaagattatttatttacttcaagagtttagagtggcagtttggggatagcaccaggagatatcagctgtgatggcttggaaaagcagtgtaaaccggcagtgtaaacaagagcagggcatgtatgagtagttgagaacggtgaataggagtatgactagacagaagatagtagggatgacaagttttttgggggcacagtctaagttggtctggtgtctggaatgagactggggcctaataaaaaggagcgtctatacaggagcttaaatgggctgtaccttgtagcattctgaggacaggcctgaattctgagaagctaaaatggtaaaagtattgtccagtcctttttaagttggtggctgagcttggtgaggtgtgtttttaaaagacctttagtccgttctacttttcttgaagacagaggaccgtaagggatataaaggtttcactgaatactaagagcctgaaaaactgcttggctgatttgactaataaaggctcagctgttatcagactgtattgaggtgggaaggctaaactgaggaattatgtctgacagaagggaagaaatgactatggtggccttctcagaccctgtaggaaaggcctttacttattcagtgaaagtgtctatttagactaagaggtattttagtttcctgactcgggacatgttgagtaaagctaatttgccagtcctgggtgggggcaaatcctggagcttgatgtgtagggaagggagggggcctgaataatccctgaggagtagtagaatagcacatggaacactgagaagttatttccttgaggatagatttccacgatggaaaggaaatgagaggttctgagaggcgggctagtggcttgtactatatagcatagcctgcctttgctggtgtgtggcgattaggcctgatggaactgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaagtccaggccaggaacaatggtaattgtgggacttaaagagtgagtacagctgaaggagccggggagcagaaagtatatgcgtcaggtatgaggaagaaaatagattttggaagttatgagacatgtagagagtgaggtgagcatagtttgtgatttttagggcctctaacagtattaaagcagcggcagccgctacatgcagacatgcgggctaggctaaaacagtaaggtcaagttgtttggacagaaaggctacagggtgtggtcctggctcctgtgtaagaattctgactgcactaaccatgcctaggaaggaaaggagttgttcttttgtaagggattgaggtttgggagattaatcggacacgatcagcagggagagcacgtgtgtttttatgagaattatgccgagataggtaacagatgaggatgaaatttgggcttgattgaagtaatgggggctgtctgtgaagccttgcggcagtacagcccaggtaatttgctgagcctaatgggtgtcagggtcagtctaagtgaaggcaaagagaggctgggatgaagggtgcaaaggaatagtaaagaaagcatgtctgagatccagaacagaataatgggtagtagaggaaggtattgaggataggagagtatatgggtttggcaccaaggggtggataggcaaaacaatttggttgataaggcgcagattctgaactaacttgtaaggcttgtctggttttaggagaggtaaaatgggggaattgtaaggagagtttataggctttaaaaggccatgctgtagcagacgagtgataacaggctttaatcctttcaaagcatgctgtgggatgggatattggcattgatcggggtaagagtgattaggttttaatgagatgttaaggggtgcatgatcggtcgccaaggaaggagtagaggtatcttatacttgtgggttaaggtgggggatacaagaggaggacgcaaaggaggctttggattgggaagaagggcagcaatgagatgtagctgtaatccaggaatagtcagggaagcagataatttaaagtgtctcggcctaataagggaactgggcaggtggggataactaaaaggagtgcttaaaagagtattgtctaagttggcaccagagttggggagttttaagaggtttagaagcctggcggtgaatacctaacaacagttatggaggcaagggaaacaggcccttgaaaagaaggtaatgtggagtgagtagcatccatattgattaaggggacggacttaccttccactgtgagagttactcgaagctcggcgtctgtgatggtctacagggcttttgaggtgatcgggcagcgtcagtcttcagctgctaagccgagaaggagtcagtcagagagccttgggccagagttccaggggctctgggagtggctgccaggtgagttgaacagtccgatttccagtggggtcccgcacagatgggacatggcttaggaggaatcctgggctgcaggcattccttggcttggtggtcagatttctggcacttgtagcaagctcctgggggaggagtttctggaggaacgcctggctgctgcggttcaggcgtttagaagttcttgtgtgctggagatgtggctggggtttgtctcacagtggaggcaaggaattgcaactttttttttattattgtacaccttgaaggtgaggttaattaagtcctcttgtggggtttgagggccagattccaatttttggagttttatttaatgtcgggagcagattgggtaataaaatgtatattgagaataagatggccttttgaccttttagggtctagggctgtaaagggtctcagggttgctgccgaacgagccatgaactgggctgggtttttatatttgatgaaaaagagcctaaacgcttctgatttgggataaagaaaaaggagcattaaccttgactatgcctttggctccagccacctttttaagagtaaattgctgggcaggtgggggaggcctagtcacagaacgaaactgtaagccggaccaggtgtgaggaggggagatgataaaaagattacagggtggaggagcggaggctgaggaagaattggaacctagcttggcctggcgaggaggggagaggtcagatgggtctgtagaaaaggaagattagagagactcagcgacgcttggggttgggactgaggggacaggtgggagggaaagaaggaagatttgggacgagttgcactgggcacagagactaggaagggactgatgtgtaaaagaatgcctggatgtcaggcacctcagaccatttgcccatcttacaataagaattatttagatcttgtaggatggaaaaattgaaagtgccattttccggctatttggaactactcgagtttgtattggggtcaagcgacattgcagaagaaaataagatgcttagattttaggtcaggtgagagttgaagaggttttaagttcttaagaatataggctaagggagaagaaggaggaatggaaggtggaaggttgcccatagtgaaggaggcaaacccagagaaaagagagcatagagacacggagggaaggggttcaggggttcttaccctccagaaaagcgggaagggtggttggggcatggaaataagggattggggcacagagataagaggttggggtgcagaaataagggattggggcacagagataagaggttggggtgtggaaataagggattgggggttcttgccccctagaaaagcgggacttgctgctaagggtgaaggagaaggggttgaggggtacttgcccctcccccagaaaagcagagaaggggtagagacacagagagaaggggttggggtacttgccccttccccagaaaagcaggacttgccactaagggtgaaggaccaaggcaggcatccctgtgtggtctgacacctttgaaacatgggtgaataatcagagaggcgtccctgcaatgattaaacacctagggaaggctgccttcccagtccatgaccggcgccggagttttgggtccacggataaaacgtgtctcctttgtctctaccagaaaatgaaaggaattgaaattaagagaagggagagattgaagggtggcaccaagattgaaaggagaaagaggttgagggatagtgagggaagctggagaagagagtaaaaagaggccgcttaccagatttgaaattggtgagatgtttcttgggctggtcggtctgaggacctgaggtcgtaggtggatctttctcatggagaaaagagcaggagaacaggggattgatctcccaagggaggtcccctgatccgagtcacggcaccaaatttcactcgagtctgtgtgaagagaccaccaaataggctttgtgtgagcaacatggctgtttatttcacctgggtgcaggcaggctgagtccgaaaagagagtcagcaaagggagataggggtggggccgttttacaggatttgggaaggtaatggaaaattagtcaaagggggttgttctctggtgggcaggggcgggggtcacaaggtgctcagtgggggagcttctgagccaggagaaggaaattcacagggttaatcactcagttaagatggggcaggaacaaatcacaatggtggaatgtcatcagttaaagcggggcagggccttttcacttcttttgtgattcttcagttacttcaggccatctgggcgtatacgtgcaagtcacaggggatgcgatggcttggcttgggctcagaggcctgacaataatacctgtgaattttgagggaaaatgaccttgaacctagaattctatattagtcaaatataagaataaaaataaaaagacatgtttaggcatgagagaactcagaaattttacccctagccctcttctctgaaaaaaattacttgaggatgtattctaacaataaaaaaaaaaagagatccaagaaagagaaagacctaggatgtaagaaacagagatgataacccaggaatgcaatgaaaaaaaaaatcctaaaatggtagctgtgaaggagtgaggcatagaaagagtgggtatatgttagagcatttaacaagtcgtctatgtgaacaattggaaggtatcagtaatatggtgacaaaggcacctatatcttctgccaaaaaataattagaaattttaagaaaggaaaactttcccaaaaagtcatgatccatatatcaaacaatctaaaatgtggcataactcagcaattggagtgtaagaaaagaaaaaccatttgaactggaaatttgtactatttcccttcaagtggcctaggtatagggatacaggattacatctcctccagtgatcaaatcacacattctgttttctgcaactaataacatttacaaaattataattttgtaagtgatgtttattggctttcagaatcaacctatagaaaaagtatgaaagacaaatatagttatagaatggaatgtaaatatgaaaatggtttaaactttaacaatgttaaagtactcaaataaccaggaggagtggggagtaatttcttcatttgacacagtaagcctcaagaagtaagtgtaaatggaagcttaagtacattatgcaaagtgttaatggtaaacaattgaggagctaacaaaaaagaggaaagtcaatactgcttaaaggaaataaatcaagatttcaaagtaaaagcatcttattaagaattatggaaataaccaacagaaaaaaaaatcccagaaatggtcaaaagaagctcaaaggtatcaaatgatactctgattagtaagactgagggtaagagcaggaagaatctttgtacttttaattttgtaacctcccacatagctattccattcagtcattcattccttcagcaaatacttatagaacattattattgtaccaggcatgattcgaagcacagggatacaggatagacaaggcggagaatattcctgccctcaaggaactcatattctagtgggcaaaggtatacaatagacaagtaaattgtttccccaaaaagataggtacaaatattaagtgcaatgaaaattataaaacaaaataaagtgataataacttgagtgatcagggaaggcctctctgaagaagtaaaatttgagctaaaatacttttttatatgagaaacgtataggatttcttttcttttttttttttttgagacagagtttcactcttgttgcccaggctacagtgcaatggcacggtcttcgctcaccacaacctccgcctcctgggttcaagcgattctcctgcctcagcctcccgagtagctgggattacaggtatgcaccaccacacctggctgattttttttgtatttttagtagagacggggtttcataatccctttcttccaaggaggctccctggcccctatgcaaatttacatacttcctccccagcaaccagctcaacaaaccaaggaatttgcggagaggcagtctttgtcaaaccacaaaagatcttgttacacccttagcccaaagcaataattacctacctgcctcagatttacccagagagcatttccaagtgattgttcccagcacaaggaagacatgctgcaaagtgacttgttggaaaatgttcaagtaccactttctttccctatgattccctaacccgtgtccagcagcaccaggaagagatccaggctcatctcaaggtggggtctccagagaagcatagtgaagggagacccactacataggcagaactgcctgttcatacctgacagcaaagccctatatgtaggtcctaagtctgtgctacgatgctattgtagctcgttaccaatgctcttttgaaacacacagcatgaagcaccttgacttactcaacatcctgtactacactgaggcatgtttttggccacaggaaaacaaaaaaggctaaagaagctcaacagagctaccccatcctccctcaatcaccaagcattcctaggagacgttccttacattcctcaccaactctctgccaactgtggtcatagcataataatcattgaagtcaacaccttcatgagaacaacccactttctctcttcagctggaccactttctgccccagttatctctaccttattcttcagagacataattgttccacctctaagacagcctaccctgtaacatctgactggggagcccaatttgtgcaaagtttctatagagcacacttctgatccaccatgtccaaatccacttgtccattgcccacaacaatcaaactgaacaacagccagatagattttggaggagacttctggttgtcattcaccttcaacaaataagataactgggacacacacctcccaaatgctaaatttgcttaccatactctgcacccatctattagaggaccctttttcatagtcattgcagctttctttctcataccaaccagctgcatcaccatcttttgctttcggtcaacagatgtcaattatctattatgcaccagacactgtactggatgtgagggtcatggctgcccataggccatgaggtgactgcgtgcaaatttgaaaaaggctctccagatgcacacctctgcaccaggttgcatgaattggtgagtacagcgaaggctggatttcaatccttactgatcctctcaaccagattcccttgtacagtgaacaattgtacccagcaggcatatggggattgaacaataagagtcttgtggctaactggaagcattctagattcccccaggaaggccaaagggacatctgcattttccaaatatttcatcaagttctcctactacagtgtctgctccacctgctgctattacatacccaaggaccactcccagggcccagttacatatctggagattatgaaccctgtcacctttgcctccagcttcccctttttcatgtatacccacctcatctttcaccattcctcactagactcagctggcctcaactccacccagcacctcactgtgtactttatacccataggatccaatgttgcacaataagaaacccaaaagacacaatacgggaaattttggagcaagacactacctccagtactgatcttacctcaccccatttagcagggaggaagtgaaaggcaggaggggacatgtccaatcctgctctttcttaggctgatcaagtcacccccaaatagatggccaacctctactgagaggggccttcacatccctctgccttggccaaacactgtgttctttgtacctcattcccagattgagccagctgaagcaaaacccagtgaagaccacctttaccgttttttaatagaatacataaaaccccagtctacagcatctgccttccccttttccaccaccatcgaggaacactggcagataggtaacttactaagaggcctcaatgaagtggtctgtcccagagaaagggcaggtttgacccaagacaaattccagatcctctgcttagagccgcaggaagaaatgctgaaaccaaaccaagccaaacaacagaaaccccagcagtctttcatctgctctaaatctagatgatttcaaaagtgtgtccatcatgaaaagatccctaggggtttgcttgtactagaagagcataaacatttacattgccttttttctgctgacagaacagtgagagggaagggcctcatctggcaacttaaagcaataccattcaatcatcccaaagccagttctttgtgtatgtaagtagctgcccttgcaggaggcttaaggtgctgggagctcagggtcctgagtcaaatgatctggcttcaaatctcacctctaccacttacagtttgaactataaggaagctgtatggtgttacagaaagtacacaggctctggacacttggctgccaagtgtaaatccctgctgccccacttaccagctgtgtggcctttatgatatacagtgcctcagtttcctcatctctgagatgatagttatactccctgtaacatcacgggactgttatgaggcttacatgggaccatccacaacctcacctacagtaaatgtttactaaatcttagtgattattattccattctgagtctatttctcattccttgaaaatgagaagagaaaggggcactgctctgcataatcatgtgaggcaccatcgcccctgtgagctgggaaagttgggagaaggtttcttttcttccatttggatttagacggcattctctctgagaatctgttgtttagcctgaagagatagacgtgcgtatgtgtttcatccaaccatcacccacgggatatcaggaaaaacaaaaaagcatttatctctctgtgacccctactgatggggacctttggaaagcgatgacacctggaatgccagagcctaccctaacctgtccatttggaaggctcagagccatatgccaggctgaataactaagatgtgggccagtgggcttctagggaagatagaggtgggacctggggcaagaccaagccctgtgagtaggtagtgggtggagcttcatttgatgggttgaaagaagaggaaaaaagtgaagctgaattcaaggaagaagggcatgagggttctctctgtgatgggcctctctggtgattttctcttggtctacagacatggacatgggcagtagattattttttaaaagtccccatacttgaaattcctttcagttattcacaggccttctgcaaaatctgtacaaccctggtggtgatgttgggaagtataaatgagaggacagtataggaatgtatggtgtcccctcattcactcaccagtgtctgtttatccttcttagaaggggacttgagtgctggatttctggaggagatcagtggaaaattgagtgttggtccatggaacagcagagaagagtagccgccagatgaatggctcagggagggatgtgggcctaaccctgtactttgtgatatgtatactagaagaaaatgactggtaaaggaggaacagcgagatgacattggagctattgtgtatctttgggtgtgttacttaacatcctggtgcctcagtttcctcatctgaaaaatgaggataatgatagtacctagcacataagactgttatgaggataaaatgagttaacatttgcaaaatatttcagtgaccagcacacgttaaccatattagaagtgtttgttaaataaaattaaagttcaactgacagaagtgtggagtgactgataaatgatatattgaaaatgcagagctgggcagtaaaaatttatcttcctcttcaggggaaagacacaagtattctggccacgagaatgtgtactccaatatggagcagggggccagggctccactgctttccatgttaagcttattttcccacagaggaccagactccaccatggtctaatgcacatttgtttcccgtccagccagaatacaaagcagaaaggtgattccaaccccaagtgaagaagaatttccttcttgaaatacccttgcacatatgcacaaacatacatcaacaagggtgttcactgcagcatttcttgtaatagtgaaaaacaggagccaatagaaattacaactaacaaggactggccgactgataaagattaaaccaaaaaaaaaaaaagaggtgcatgtatgtggatgtgcactgataagtagccaaaatatactgtttcatgaagaaaatagaagcagaatagtatgaataaatgtcatcttgttaccagtggaggatatccaggttcttggcattttgaacaaagaattggacaaaatgcataaacaaagcaaggaaagaatgaagcaacaaaagcagagatttattgaaaacggaagtacactccacagtgtgggagcaggctgagtagaggctcaagagccctggatacagaatcttctggggtccaagtaccccctagagtttcccattggacactttgtgctcacctcatgtaaataaagtggtggcccgcaatcagtgtgattccaatcagaggctgaagtgaagttacaaagttacacccaattagtattggttgcagcaaccaattaggggctgaagtgaagttgcaaagttgccctcctatgcaaaaagcaaccaatcagaggtactttcaatttcccatctgtggtgcagaaaaggtgggggtttgcaaaggcagtagcctctggtccttttgttacttaggcgtggaaagttagggttttcctttcaatttagttctaggaagtcagcatgaaacagctttaggttccctgcctccagacgttattctcctgcctcaatctcatctgtggggggtgtgtgtgtgtgtgtgtctgtgtgtgtgtgtgtatccctttcagacacacacacacacacacacacacacacacacacacacacggtgtttatccacccagcaaaaactcctgggtggataaacaagaaaatggtaacagtggttacccctgcggaatggagctgcggatgagggtaaagggaaaggagatttcacttgaattttgggagtttatttttattttggcttattttcacaataaaactagttttttgtgttttttttttctgattatataagcaatatatgtttattctttttttcatattttaacttttgatttggaaataatttcagacttataaaaaacttgcaaaaacagtacaaagaattcaaatatctgccccctaccagcttcccaaatgttaacatcttatataaatcaaacccaggaaattaacatcaatatgatactattgactaatctagaggctttatgcagaagttgtcaattggctcactgctgctctttttctggtctaagatccaatccaggatcccacattgtatttacttgttatatttcctcggtctcctgcagtctggtacagcttctcggtctgtctttgtttctcatgacctggacactttagaaaagtaacgcctagttattatgcagaatgtctctcaatttaggtttgtctcatgttttcttatgactaagtacaggttatgcatttgggaaaagaaaatcacagaattaatgcaaggcccttttcgctgcatcctattaagagacacacaatgtatatgtctaattactggttatgttaactttgaccacttggttaaggggtgtctgttgggttgctccactgtaaatttactccttttcttttccaaattagtttatagcttgtggagagatagcttgagcctatatgaatatcctgtttctcatcatactttgcccactaaccctttgatgattcttgcctaacacaattattactgtgatatttgtcaaatggtgattttctatttccgtcattccttctacatttattaattggcattctactgtgagaaagtgctttcccttctccctatgtatgaattcaattatttatttatgtaactatggacttgccaacagaatgtattgccgtactttttaatttttgctgatctgatagggggaaatgatatcctggtgttgctttaattgcatttacctaattatatgtaaggttacaaggttaaggagctatttactgatgatagataattgtctgttcacgtatttctccattttcctattcagttttggggacctatgcccatcaattttgaagcattatttgtagagtcacaattttagcccctttatctgtgatgcatattgcacatatttgcttccagtttctcagttgttttttggtgttgattatgatgaggctttttgccatggaattttaaaatgtagtcaagtttatccatttttttcttttattgcttctagattttgagtcatgattaaagagcctttccctacaccaagggtaaaagggaatttgttcacattttctttttttttttttttctttttttgagacaggatctcactctggctcgagtgcagtggcgtgatctcagttcactgcaacctccaccccccaggctcaaattgagaggtgacagcgtgctggcagtgctcatagccctcacttgctttcggcgcctcctctgcctgggctcccactttggtggcacttgaggagcccttcggcctgccgctgcactgtgggagcccctttctgggctggccaaggctggagccaactccctcagcttgcagggaggtgtggagggggaggcgcgagcaggaaccggggctgcgtgaggcgcttgcgggccagctggagttccgggtgggcgtgggcttggcgggccctgcactcggagcatctggccagccctgctggctccgggcaatgagggacttaggacccgggccagtggctgtggagggtgtactgagtcccccaccagtgccagccgaccggcgctgtgctcgatttctcaccgagccttagctgccttcccgcggggcagggcttgggacctgcagcccgccatgcctgagcctcccacccactccaagggctcctgtgtggcccgagcctccccgacaagcaccaccccctgctccatggcgcccagtcccatcgaccacccaagggctgaggaatgcgagcgcacggcgtgggactggcaggcagctccacctgcagccctggtgcgggatccactaggtgaagccagctgggctcctgagtctggtggggacgtggaaagtctttatatctagctcagggattgtaaacacaccaatcagcaccctgtgtctagctcaaggtttgtgagtgcaccaatcgacactctgtatctagctgctctggtggggccttggagaacctttatgtctagctcagggattgtaaatacaccagtcagcaccctgtgtttagctcaaggtttgtgagtgcaccaatcgacactctgtagctagctgctctggtggggatgtggagaacctttatgtctagctcagggattgtaaatacaccaatgggcactctgtatctagctcaaggtttgtaaacacaccaatcagcaccctgtgtttagctcaaggtttatgagtgcaccaatcgacactctgtatctagctgctctggtggggccttggagaacctgtgtttccaaactctgtatctaactaatctgatggggatgtggagaacctttgtatctagctcagggattgtaaacgcaccaatcagtgccctgacaaaacaggccactgggctctaccaatcagcaggatgtgggtggggccagataagagaataaaagcaggctgcctgagccagcagtggcaacctactccagtcccctttcacactgtggaagctttgttttcttgctctttgcaataaatcttgctactgttcactctttgggtccacgctgcttttatgagctgtaacactccccgtggagatctgcagcttcactcctgagcccagcaagaccacaagcctactgggaggaatgaacaactccagacgtgctaccttaagagctgtaacactcactgtgaaggtctgcagcttcactccagagccagcgagaccacaaacccaccagaaggaagaaactccaaacacatctgaacatcagaagggacagactccaaacacgccaccttaagagctgtaacactcactgcgagggtctgcggcttcattgttggagtcagggagaccaaaaacccaccaattccggacacaaaatgatcttctcacctcagcctcccaagtagctggtacccaggtgtgtgccactcagaggtgacagcatgctggcagtcctcacagccctcattcgctcttggtgcctcctctgcctgggctcccactgtggcggcacttgaggagcccttgagcccaccactgccctgtgggatcccctttctgggctggccaaggccagagccggctccccaacgtggaaggaggtgtggagggagaggcaccagtgggaaccggggctgcacgcagcgtttgcaggccagctggagttccgggtgggcgtgggcttggcgggccccgcactcggagcagacggctggcccggccggccccgggcaatgaggggcttagcacctgggccagcggctggggagggtgtactggggcccccagcagtgccagcccactggcgctgcgctcaatttctcaccagggctgagctgccttcccgtggggcagggcttgggacctgcagcccgccgtgcctgagcctcccaccccctccgtgggctcctgtgcagcccgagcctccccgatgagtgctgtcccctgctctactgcggccagtcccattgaccacccaagggctgaggagtgcgggcgcatggcgcaggactggcatgcagctgcacctgcagtcccggtgcagaatccagtgggtgaagccagctgggtttctgagtctggtggggacgtggagaacctttatgtctagctaagaaattgtaaatacaccaatcggcactctgtatccagcttaaggtttgtaaacacaccaatcagcaccctgtgtctagctcagggtttgtgactgcacccatcaacactctgtatctagctactctggtggggccttggagaacctttatgtctagctcaaggtttgtaaacacaccaatcagcaccctgtgtctagctcagggtttgtgaatgcaccaatcgacactctgtatctagctactctggtggggacttggagaatctctgtgtccacactttgtatctagctaatctggtggggacgtggagaacctttgtgtctagctcagggattgtaaacgcaccaatcagtgccctgtcaaaacagaccactcggctctaccaatcagcaggatgtgggtggggcagataagagaataaaagcaggctgcccgagccagcagtggcaacccgctcgggtccccttccacactgtggaagctttgttctttcgctctttgcgataaatcctgctgctgctcactcttttggtccacactgcctttatgagctgtaacactcaccacgaaggtctgcagcttcactcctgcctgagccagcaagaccacgaacccaccagaaggaagaaactccgaacacatccgaacatcagaaggaacaaactccagacgcgccaccttaagagctgtaatagtcaccgcgagggtccgcggcttcgttcttgaagtcagtgagaccaagaacccaccaattccggacacaccaccactcccggctatttttgtgtgtgggtatttttagtagaggcagggttttgccatgctgcccaggttggtcttgaactcctgactcaagcaatccacccatgtcagcctcccaaagtgttgggattacaggagtgagccactgcgcccagcctcttttaatatctgtatagtttcatgtattacacttggatccttgatccatttagagttaattcctgtgtgtggtgtacagattggacctcattttatatttttccagataactagtcagtatacccagcaccttttacaaatctttgtcccagtaacatatatttattctttaaaaattctggtgataaatacaagtttaaggaagaaaaaaatcacaaacaaatcctacccagagataaccgcaaattatgttttggtagactgctctggtttaaatatttgacccctctgaaactcatgttgaaacgtactccccaatgtaacagtattaagaggtgaggcttttaagaggttattgggtcatgagggctgtgccctcattaatggattaatccattcatggattcatgggtaatcatgggactgggtctgttataaaagccagtttggcaagttcttgtcctctcaccatgtgatgccctctgccatattatgatgctgtaagaagtcccttaccagaagtggtccctcaaccttggacaaccagcctccagaactgtaagaaataaatttcttttctttgtaaatta

SEQ ID NO: 3665 - DNA, 44081 bp, human; identical to SEQ ID NO: 3664

SEQ ID NO: 3666 - DNA, 44081 bp, human; identical to SEQ ID NO: 3664

SEQ ID NO: 3667 - DNA, 37294 bp, human
tttaaaaagaactgtgatatttgacaaatacacttgctttgttcccagtcatcattttcactatgtctttggcagcagttttggtaagtgtgtgaacaatgaattcagtaggtctaacctttgcaattcagtacaaccttataaaatgtggtttccatagcttttgcctttggcctgttgtgtttagctttaggtgatgatgaaatgtccttccattctaggtggataagtctcacgagatctgatggttttaaaaatgggagtttccctgtacaagctctctctttgcctgctgccatctgtgtaagaagtgacttgctcctccttgccctccgacatgatcatgaggcctccccagccacatggaattgtaagtccactaaacctctttcttttctaagttgcccagtctcaggtatgtctttatcagcagtgtgaaaatggaccaatacaccaggtcatggtaatccaaatttcagttatttttcatgggagttgcatgatacttttagtttctttgctgctgtttttttttttgtttgtttgtttgttttcagagacagggtctcgctgtgtcacccaggcgggagtgcagtggcatgatcataactcactgcaacctccaactcctgggtttaagtgatacccccacctcagcctctgcagtagctagggctacaggcatataccaccacgcccagctaattttcaaaatttttttgtagagatgaggtctcactatgttgcccaggctggtcttgaactcctgggctcaagcaatcctcctcctgccttggcctcccaaaatgttgggattacaggcatgagccactgtgcctggcactgctggtatttttttttttttttttttgagacggagttttgctcttgttgcccaggctggagtgcagtggtgtgatcttgactcactgcaacctctgcctcctgggttcaagtgattctcctgcctcagcctcctgagtagctgggattacaggcatgcaccaccacacctggataattttgtttttttagtgagacggggtttctccatgttggtcaggctggtctcaaacttctgacctcaggtgatctgcccgcctcagcctcccaaagtgctgggattacaggtgtgagccaccgtgcctggccagtatttttttttataccaatagacggtccaagtgttggagtgatacatctctaataactatctgaagacctacgattaaagtcataacatttttaccacaaattccaccactatactttttgtaattgatatgcagcataatcacatcatattttggtgtagagtcctaggaatttgagcacatgtataggctggtgtgaccactaccacaataaggatccagagctgttcccaacttctcatgtgctgcccttttgtagtcaaggcctccccaacccccacctgggcaaccacagatttgttctctatctctatcatgttgccttctgagaatgtcatataaatggaagcatatagcatgttaccttttgagactggcttctcccactcagcacaatacctttgagatttatccatgttgtgttcatcaatagtttcttccttttgattgctgggtagtattccatagtatggatgtaccacaatttgtttatccattgttttagtttgtgctgctacaacaaaatacctgagactgggtaatttatttatttatttatttatttttttgagacagagtcttgctctgtcgcccaggctggagtgcagtggtgcaatctcggctcactgcaacctccacctcccgggttcaagcagttctcctgcctcagcctcctgagtagctgagattacaggcacccaccaccacgcccagctaatttttttgtatttttagtagagacagggtttcaccatgttggtcaggctggtctcgaacccctgacctcgtgatccacccgcctcagcctcccaaagtgctgggattataggcgtgagccaccgtgcctggccaagactgggtaatttataaagaacaaaaattgatcgcttacagatccggaggctggaaagtccataaccaaggtgctggcatctggtatggtgagtctttcttgctgcaccaccccatggcaaaaggtggaatagcaaactaatcaaatgctacatgaagcctcttttataagggccttattccctttaatgaaggagaagccctaatggcttaatcacctgttaaaggcaccacctcttgatgccatcacattggcaacacctttattttggaggggacacattcaaatgatagcatcccttcatccgttgatggtctgattctggtttttggctattatgaataatgctgctgtgaacattcatgtacagatgtttgtatgaaaatgcttccttttatttactacctaaaaggtagcattctatagacatatctttggcactttgctttttcactgtaactttattttagaagtcactccacttcagtttgtagagagttttctcacttttttttttacagccacatagtattctattgtatggatgtaccatagcttattcaactataaacctatgtatggacatttatattatttccaatattttgcaattttaagcaatgttgtgatgaatgaccttgtgcatatgtatctttggatcattaggggtttatcttcatctactgtgacatttaaaaatcctatttataggctgggcatggtgactcagcctatgatcccagcactttgggaggccaaagcaggaggatcacttgaggccaggaatttgagaccagcctgggccacatagtgagatgtcgtctttacaaaaaattttaaaaattagctgagtgtggtggtgtgcacctgtagtcctagctattgtggaggctgaggtgggagactcccttgatcccaggagttcaaggccctagtgagctatgctctccaacctgagtgacacagcaagacctcatctctgaaaaataaaaataaaataaaatcccatttgtaatcactgacccacggtgagtttaacagaaaacaaaacagaaagaatgaagcacaggcccaacttctaataaaaacaatacacacttttacctatttcctgttctaaagagttgtcaacttttataaaccatgtgctggtgtaccaatgaaaaaaattaattgaagtttatgaaccttcaagatacaaggccccatcttgctgctctgggttgtgaagtatgtcccaaaatggcagtagttatttgcaatgggcagatcaaggaaacatgaggtgtgcacgctgggttattggccacgtgaatgttgaaatcactgagaatgacaggggaagctgggacaaagaggacagagagactgtgagtacagaactaaattcttcacaaatgagggtagtgactgggaaggtatagaagactgctaccaggaatgggagaggatgatacaagcggatagcatgagccaaggaagaaccaaagatttctcaggagggaggaggaacaaagatcagaaagtggtcttggggagcgacgagagctcgagctccacctcctggcactccctgaggcatttagctgtgggggggatgagaaaataaacagctcgcacttgaaaggggtcagcagacagccaaggtttcaattacagcagggatgggggaagaatatcttgagagatttgaggctttgggatttaacccatcatagacttggagtgctaagcttaacttaaatctctctcaacctaacctgctgataaggtccagcagttggagtgtaaagtgttcttttacttctaggtcagttggtatttggcagcatcaatgaaagggggtgcagtgagccagtagccttttgctattggggcattggtgttatcagtagaaggtcttgactgcaagctgtccagattcttgaagttttgaacaaataattggacaaaatgcacagcaaagcaaggaaagaatgaagcaatgaaagaatgaaagcagggatttattgaaaatgaaagtgcactccactgtgtgggagcggcagagcagcggctcaagatccccggatacagaatcttcttgggtccaaataacccctagagagttcccattggccacttgatgttcaccccatgtaaatgaagtggtggcccacaatcagaggcgaagtgaagttacaaaggtcacactcctatgcaaacatctgactggtgcaagcaatcagaggctaaagtgaagttacaaagttacactcctttgcaaagttacactcttttgctttttgcaaccaatgagaggtactttcaattacccatctgccatccagaaaaggtgggggtttggaaagggagtagtctctggtcctttggttacttaggcgtggaaagttagggttttcctttcaatttagttctaggaagtcagcatgaaatggccttagggtccttaactccagtccctattctcctgcctcactgggagtggttttcagtgtctctgctgggtgttctccaaggttggcctgagggcctggttggagggtcacaaggtggagctcctcctgccagtgtggcatgcatggctgtagtgtttaatgtctgtccccaaacaagagactagccatatctaccacaatattgccgtcctgatgtttttgcctataatttgcatcagattttgttgcatttaaaagatatcaaaggaaaacactgactgactacttagctagacttctccagacagcagtaccttggtgagggtccctgctgttgatttcttagctctgcagatccagaaattcagctttatcaggataccctgcagccagcaggctcagaaggctgactcttgataactaccgccactccttcttggtctcctttgttggttcttcctcatctccatgacctctaaaatattcgagtgctctaggctaactccttgagctttttctccatttaaaccgatttccatgctgatctcatttagtctcatgggtttaaatgtcatctatgtcccgatgactcccaaatatatactgtagtattccctcatctgaagtttcatgttcctcagtttcagttacctgtggtcaactacagtttgcaaatattaaatggaatattccagacataaacaattcataagttttaaattatgcaccattctgagtagtgtgatgaaatcttgctttgtcctacctgggatgtgaatcatccctctgtccattgtacccaagttgtccatgatacctgcctgttggtctcttagtagctctctcggttatcaggtgaaaaaaaaacagtatatatattgggttcaatactatccatgttttaaggcgtccaccagggatcttgggacagatctcctacagataagagaggactactgtatctctagtttggacttctcccctgaactctggactcccattgagaggtgacagcctgctggcagtcctcagagccctcgcttgctctcggcacctcctctgcctgggctcccactttggcggcacttgaggagcccttcagcccaccactgcactgtgggagcccctttctgggctggccaaggctggagcccactccctcagcttgcagagaggtgtggagggagaggcgcgagcgggaaccggggctgcctgcggcacttgcgggccagctggagttccaggtgggcgtgggcttggctggccccgcactgggagcagccggccagccctgctggtcccgggcaatgagagacttagcacccgggccagtggctgcggagggtgtactgggtcccccagcagtgccagcccactggcactgtgctcgatttctcaccgagccttagctgccttcctgcggggcagggctcgggacctgcaacccgccatgcctgagcctcccacccactccatgggctcctgtgccgcctgagcctccccgacgagcaccaccccctgctccatggcgcccagtcccatcgatcacccaaggaccgaggaatgcgagcgcacggcgcgggactggcaggcagctccacctgcaggcccagtgcgggatccactaggtgaacccagctgggctcctgagtctggtggggacgtggagagtctttatgtctagctcagggattgtaaatacaccaatcggcactctgtatctagctcaaggtttgtaaacactccaatcagcaccctgtgtctagctcagggtttgtgaatgcaccaatggacactctgtatctagctactctggtggggccttggaaaacctttatgtctagctcagggattgtaaatacaccaatcggcactctatatctagctcaaggtttgtaaacacaccaatcagcaccctgtgtttagctcaaggtttatgagtgcaccaatggacactctgtatctagctgctctggtggggccttggagaacctttatgtctagctcagggattgtaaatacaccaatcagcactctgtatctagctcaaggtttgtaaacacaccaatcagcaccctgtgtttagctcaaggtttgtgaatgcaccaattgacactctgtatctagctgctctggtggggccttggagaacctgtgtgtcgaaactctgtgtctaactaatctgatggggacgtggagaacctttgtatctagctcagggattgtgaatgcaccaatcagtgccctgtcaaaacaggccactcggctctaccaatcagcaggatgtgggtggggccagataaaagaataaaagcaggctgctggagccagcagtggcaagccacgtgggtccctttccatagtgtggaagctttgttcttttcctctttgcagtaaatcttgctattgctactgctcactcttttggtccacactgcttttatgagctgtaagactcactgggaagatctacagcttcactcctgaagccagcgagaccacaagcccaccggaggaacgaacaactccagacgtgcttctttaagagctgtaacactcaccgcgaaggtctgcagcttcacttctgagccagcaagaccacgaacccaccagaatgaagaaactctgaacacatccgaacatcagaaggaacaaactccagacgcgccaccttaagagctgtagcactcaccgcgagggtccgcggcttcaatcttgaagtcagtgagacccaagaacccaccaattccggacacaccatgttcagaggcccctttagtagctccacttagatatttcatatgcatctcaatcataaagtgtctcaagtgagacccctgatctaccccaccaaatctgtccctcccttgccttccccatcgtggcaaatggaaacttttttttttttttttgagacatagtcttactctgtcacccaggctggagtgcagtgttgtgatcctggctcactgcaaactctgctcccgggctcaagcaattcttgtgcctcagcctccctagtagctgggactgcaggtgcacagcaccacacctgactaatttttgtattagtagagacagggtttcaccatgttggccaggctggtctcgaactcctgatctcgtgatccttccacttcggcccaaagtgctgggattacaggcgtgagccaccacatacggccaattgatccttttagcatgaaagtcagatggtgtcacttcactgtttggaaccctccaatgactctacatctcaaaaatccaaaatcctaatactgctctgcaaggccctacacaatctttccctcatccccccactgcccccacattatctctctgactcctcgccactactctctcctgtgttcactctacttcagtcacactggcctttctgctgatccataaacaaaccaggcactccccacctcaggcctctgcgcttggtgtctcttctgcctggaatgcttttccatagccatctgaatggttgcttcttcacctccttcagagatttgctcaaatgtcttcttcccagtgaggcctgaatactctgtttaaaattgtaacccccaccttggtacattctgtcccccttccctgctttcttgttttctatagaatttaccactatccatctgacacactatatatttttcttaaaaaaacctctctctctctctctttttttttttttttttgacagagtcctgctctgttgcccaggctggagtgcagtggctcgatcttggctcactgcaacctctgcctcctgggttcaagcaattctcctgcctcagcttcctgagtagctgggattacaggcatgcaccaccacatgtggctaattttttgtatttttagtagagatggggtttcaccatgttggccagactggtctcaaactcctaacctcaagtgatccgcccacctcagcctcccaaagtgctgggattacaggtgtgagccaccactctgggccaaaatctgtctctctttagcctactaagatgtaagctctgtgagggcagaggttttatctgtttggtatacttctatatttttggcatttaaaactgtagcctactaggcactcaataaatatttgttaaatatatgaatgaatgaatgattctactcataagttacagatatatatgaaccaaaatgtcagtttattaattgacagtgagaactataactgttaagcagacctgaatactcacataggatattcagggaaccctcttccctttagggaagtcttaatgggctatcacactgcaataagaagttagtataaaacacagccttagagcaaagggaaatattaaaatactcttcataggtcgttctattttattttctttttttaaatgaacctgacattgtgagcataacttcacaggtaattctgccaatccatcttcactttaggaattccttccaagtggaattgtaatattcatagaagctgctctgggatcactcctgcacagggctctttggctttcttttatccagtttctttttttcttgagatggagttttgctcttgttgcccaggctggagtgtactggtgggatcttggctcactgcaacctctgcctcctgggttcaagcgattctcctgtctcagcctcccgagtagctgggattacagggacccgccaccatgcccagctaatttttgtatttttcatagagacagggttttaccatgttggccagactagtctcgaactcctgacctcaggtgatctgtccgcctcggcctcccaaagtagtgggattacaggcgtgagccaccatgcccggctcttttatccagtttctatgtagcagaaacacagataaattttaagttttgcacttgagcaaatgggtggatggtgatgtaattaattgagatagagaagaaatttaagcttattgatgactttatgtgaataacttagactgaaggtgatgtgtcaggataaactataaagagtgtgaaagcttaggtaaatccaacgttagagcttgtttcatgttttcaagctgttatatcaaaagcaaagtctattatgccagagactatccaccaatatccacatgctcccttacatttccaagctttctttttgcctaaatgggaccatgtggttttgttttggcaagggaacatgtgtaggattgataactgccacttctaggcctaaaccatgtaatacccttcatgatttttcatgctattaataaatctctttgctcttgtacagcaggaagcaaaggactctgaaatggtggaacacgatgcaaggaacctgtatccttgggtttacccctcagaggaaaaccaccctggagagttgctcatacaggaaccatctcataggactttgtgtgagtgaaaaatcaacctttggttaagccactgaaatttcagggtttcttcgttaccacagcagattctagtctacctgactgtctcagtctgtttgtgtcggtatgcagaaatatctggctgggcgcagtggctcatgtctgtaatcccagaactttgggaggccaaggcaggcagatcacttgaggccaggagttcgagaccagcctggccagcatagtgaaacttcatctctactaaaaatacaaaaaattagcaaggtatggtggtgtgtgcctgtagtcccagctacttgggagtctgaggcacgagaatcgcctgagcccaggaggcagaggttgcagtgagccaagatcgtgccactgcactccagcctgggtgacagagccagactctgtctcaaaaacaaaaacaaaaacaaaaacaaacaaacaaaaagaccagcctggccaatgtggcaaaaccccatctctactaaaaatacaaaaaattggctggatgtggtagtgcacacctgtagtttcagctactcgggagactgaggcacaagaattgcttgagtctgggaggcagtggttgcagtgagttgagattgtgccactgcactccagcctgggtcacagagtgagacgctgtctaaaaaaaaaaaaaaagaaagaaagaaaaagaaatatctgagctaataaagaaaagaggtttgtttggctcatggttccacgggctggaatgttgggcatcttggtaaaagcctcagggtgcttccactcatggtagaaggcaaaggggagccagtgtatgcagagatcacatggcaagagaggaagcaagggagagaagggggaggtactaggctctttttaacaaccagctctcatgagaagtaatagagtgagaactcactcaccacttccctccctagggcattaatctattcatgagagatttgccccattacccaaacatctcctaataggccccatctccaacactggggatcaaatttccacatgagttttgggggaacaaacatccaaacaatagcactaactaacacagctacacactgttgaccacaagaaagccctctctacctgagctacacatgaaggttatgagaagcacttaatgcttgccagttatgttaaagttttttttttccagctttgttatgaggttagggtaatgaccataaataactacttttgctcaaggaagtcactgacttccctaaggaaaattcatcacttgactgagtttcaagaaaaatcttgtatctttctggaacaaaaacccttaatctgaatgatcataagcatgattaagattaactttacgcagcccaaatgtatgcttgtatgacaagcttcatcagtgttctatccttccagataaaccgaatgcagtgattgtaaaaactgtagctacagcacacatgcctttttttttttttttttgagactgagtgtcacactctgtcccccaggctggagtgcagtggcacgatctcggctcactgcaacctctgcctcccgggttcatgccattctcctgcctcagccttccgagtagctgggactacaggcgcgtgccaccacacccggctaattttttgtgtttttagtagagacgggatttcaccatgttagccaggatggtctcgatctcctgacctcgtgatctgcctgcctcggcctcccaaagtgctgggattacaggtgtgagccactgcaactggcagcacacatgccttgatggagattgtgaggctgtggtattaaatggttttcattatctgattttcctagttatgaattaaactgaagaacttgctgaaaacattttgatcataatgaagagactcttgaaatgcttgattaagtgtattctgaagaatttccccaaagtggatggcagtggtgtgtggctaattgtgtctatttgggtcctctaggaagcagatgctaatacggagttaggaatgcaggatgttgattgtggctaatacctgtgaaagataaaagggcagagagcaagattgggcaggaaaggcattcaaactacaatgcatatctgacacatgtgaaaggataaggggtggaaacagaatttggcagagttgccttagactttgaggcaaatatgacaaagtcttggtctcaacccagtggggagttctggaggaaagactgcctcttaaaagagtctcacattgggcagaagtggccaggccctagaactgccaccttgcttagttattgactggaggctgcccagggaaagcatggttttgtcaagaatactgcagccagtcttggaaggtcctgcaacctgaggctgtaagctaacttcactcctcatagttccatggcaaagtctttcttgatgggagctctgagctatgcagctccatgcttgccacagtccatcctttgtgttgcttggattaacttcagagttcttgttcagagttcctgtgaacctctcttcctgagggaagacttagaagaggaggttagtgggaagagcaatagctcatcttgctgcagttggtctcagggctgccactaggtttcattttcttccttctccacaatccattctatatttgtactgattttctgcctgcttaatctatccattgctgacagaggggtgttgaaatctccaatgataatagtagatgtgtctagttattcttacagttctatcaatttttgtctcatttattttgatgctttgttgttagggcatacacgttttaagattgtattgttttcttgagacttgacccccataatgccccattttattttatttctttttcagaattgtaaaattttattttctatatgtcaacattcttaataatacagcttgatcaaaaaaaattctgaccataagcatgttgattatttccctttggaactggtgaagtcagaaaaataaaatatttattttgaatatatagcatccaaaagattcacttaatgtggccttatttgtttatattcaaaggctttcttccctcaaaataaaggttctaaggtaaattcaagattcttttgaatgaaaaaaagaaaactggctgggcacaatgggtcaggcctgtaatcccagcactttgggaggccaatgtgagcatttcactcccaagagttcaagaacagcctgggcaacatagggagaccctgtctctacaaaatttacaaaaaattagccaggtgtagtggcacgctcctgtgctcccagctactcagaaggctggggtggaaagattgctggagccagggaagtcgaggctgcagtgagccaagattgtaccactgcactccagcctgggcgacaaagcgagaccctgtctcaaaaaacgaaaacaaaaccttctaaaacagtgagcttacaaaacgcaacagaccgctagacacacttagtgtaacgtgaaagtatgttcactgaaaagaaaatttgaagcatgaccataaacctttgtgaaaaaccataatatgccctttacttcatttgcttttagctatttcataaataccacaagagaaattggacacagtttgtgatgaaacttagaaaaatttctttttccataaaataaacaaacatgtaaatctttccctttggcttcttcttccattcttccttcactgtgctgaagagatattgagttctttcagatttttgcttacctgggtggtttccgaactcaatggactctccagataggtagttcctgcacaaggttttcctgtcacaggatctacgagttttccaactttgaaaacaatctcagccagttcatgtttcacatgctttgttcgtggaacaggtaaagctttgagaagcacgatatccccaattgtgcactgctgaagggcattgtgagcaaagtacgttttttgcttattataatactttaataaatggggatccagaacaagcctgatcactctcactttagcagtcttttgcatttttgtcccagtcaccttccccataatccatttggcatggacggataaacgaactatggacattatgtggctatggtcacctccgccactgctttgcagccatctgacctgtggagtgccggtcgcagaatgatccccattttattcttgatgacattccttgttatgaaacctgctttatctgatagaaatataactaccccaactttcttgtgttcagtgtttttttgtttttttgtttgtttgttttttgtttttttagtatatctgtggctatctttttactttatttttaagttttttgtagagatggggtctcactatgttgcccaggctggtctcaaactcctgggctcaagcaatcctcccgcctcaggctctcaaagtgctgggattacaggtgtgagccaccatacctttgacttttaatatgtctatgtctttatattaaaagtggatttcttataaacagtgtgtaattggagcttattttcttatccactatgacaatctctgtcttttaattggtgcatttagaccattcacatttaaagtgactttgatatagtcagactaatatctaccatctttataactattttctttcgtatatttatttatttaaattgatacatattagatgtacatacttttgggatacatgtgataatttgatgcatttacataatcggatcagggtaattagaatatccatcatcttaaacataaatcttttcttttaactaggaacatttgaattattctcctctagctattttgttttgttttgttttgcttttttgagacagagtcttgctctgtcatccaagctggagtgcagtggcacgatctcagctcactgcaacctctgcctcctgggttcaagcaattctcctgtctcagcctcccgagtagctgggactacaggcgcatgccaccacgcccagctaatttttgtatttttagtagagatggggtttcaccatattggtcaggctggtcttgaactcctgacctcagatgatccacctgcctcggcctcccaaagtgctgggattacaggcgtgagccaccgcgcccggcctcttctaggtattttggaatgtacaattgattcacgttaactttaatcactctactgatgattgaaaaccaggtcttatttcttctaagtgtgtatttgtgtccatttttataactgttttctatttattgctcttgttctttgttttttccctattgtctttttctgccttccctggtttaaattgagcttttcatatgattccattttatctcctctcctaatgtatcagttgcaatggttgccctatactttataatatacattttaattaattaatttatttttgagaccgggtctcactttgccacccaggctggagtgcagtggctcaatctcggctcactgcagcctcgaccttctggactcaagtgatcctcctacctcagccctgcaagtagccgggactacagatgcgtgccatgctgcctggctaatttttgtatttttttgtagagacaagttttcaccatgttgcccaggctggtctcaaacccctgagctcaagctatcctcctgcctcagcttcccaaagtgtcaggattacagacatgagccaccacgcccagcctataacgtacatttttaactaatgtaagtcaaccttcaactaacactatactgcttcatgagtagtgcaggcatcttataacagagtatttctaatttttactccccatgtctctgacctccaaaatgctctggtggcagctgtagcgtatagttcaatgggactcctgctacgcccctggcaagagtgtgctcacctcttacactgtagagccccaggttgtggagactgaaagcacaatgtcttgctactagtaggttattgagaatgatggttctcctgctttcactccttggttcctgcacccatgtatttttcctcttggcgagatggtgccatatagaggtctctaatttagtgcttacactgcatcctggaggatgctaccacatctttgcagagtgttgcttctgagctggtgcttcagctgctccttgccattccatcactctgtcaggccagctacttatgaatggtgtggaatgttgcatgcctaggggatcctatggtcataggcacgctcccaaacttcctttgctatgaaataaattccctgtttggatgctgtgctgtgttggattccatggtgtggatcaggcactccttaagcccctggatggtggtgctggatgaggttctgtgggcaggaaaggcaaaaccatattcagaaagaatgtccatcctgtgagaatgaattgctggcccttccaggatggaagaggccccgtcatccccattgctagttatgagcccagctctgtgattgcccctcctatcatccactctggcctgcagaggagagccacattgaatttactggtgatatgctggcatccctctctccagcacattccttatggactgggtgaactggatgttccctgagtccttctgtacaagagaatcctccagtgggtcttctggcctcacatgacatacgcactccagcgtgtccacctccctgagccttctcattcctttcttcactatctgccagggcaatgtaggcatttctactgcacttagtgtcagacaacatgtttttcatgcttctaggatctatcctagcattgtgtttgtgctgtcttccagggcccttccccgggtgtataccaggagagtactcctatattggtaaactatcttctatccaaatttgtgttctgtctccttgcttattacctggaattccttgttagagaaactttttgggtctctagacatcaatttccagtagtctctaaatgtctgtccttcgtgtagagtcatctaagtcttaggtccttttgggagaaggactcaaactatggtttataattgccatggtgatgtgtagggttcttcttccaggggacctagccacctcttcagtcaatgagtcctaagtctgataactcagatccaggaactaggcaggagatcatggctttttataggagtgttgaccttcaacctcctcctcatctattgccacttaaaaattatgtaattaaacgatattcttgttggcaatccacctattttgcctctagggacaacatgcactattaatcctcttaactcctggagtgtctttggctgctcctctgattgctaatcactgtggtctaagtgcagccttctgacttcgggcagttaaacacagtcactcggcccttataactttggcttccattaacaagcccagctctgtgattgcctctcctgtagtccaccttggcctgcagaggagcaacaccatggaacatcttggtgatgctggcacccctttcaccagggcattccacatggcgttggtaaatcgtgcatctcctgagccctcctgtgcaacataattctctggctggtcttcgggcctcaggttatataaccactccagcatattcaccttcctgcgctacttagttcctttcattaccatctgtcctggcaatttaggcatttcaccctcactcaatgtgagttatcactttccccagggttctaggggccaccctgactgccagtttacaccaactcctagggtccttgccacagtgctaagtcctgtattcctggacagtgcccccaaatcaataaactctcccttacctagtcttatgttctggccccattgctcaaacactctaaatccagtccgtgggacctctctgactcctagtatatgttggctagatcttacaactcctttggggtatagatcttttcctttcttaccaggcccagcgcatccctggcaggcttacaccctgacttaaccctacttactggtcttatagccaggagaaaaggtggaggcagatcttggtgccttataagggaaaggcctttgtgctgtcttcccacaaaggatggggtggatgccagcccttaatagggagagatgagttactgctgcaggctctaaaggttcagagcagtctgaggagtcaaaatctttgggagcacccacttagacattcccatgctgtttgccacgatcctgggtttgcctaactggagtgctgacttgagtatcgtggacctggcttggatgagtatacagtcacctttgaagcttggtcattctgagtttgatctctaggtttttctgctgtctcactgaacgagataagaacatctttatgagctaccaaagaggtcctctggccttcatgcttagttttcaatagttaactgccctcagccacttaattgtcccttcatatggtgtctgtgcaccttaatgacagccagccaagtccacagtccttctatgcaaagttattcatctctactcttcattgcacctgccagagcattttctttttaccagaacactctcccaagttactaccagtgacagttttagcagttgggccaccatcttgtaccagggactatccatggtccacatactacttgggaagaagtcctcatttcatttcattaagtgatccagtgccaaaaccccaatcatctcctgctttctcagaccaatcctggtaccaattgtgtcagttcaggtcctctgggaagcagatactgagacagaattagcagtgtaagaagtttattggggtctgcttgtgaattacaaaaggggaggaagcaagattgggcaggaaatgcctcagaccatgacacagacttgacacttgcggatagaaaggggaaaggcagtatagttgggaagggagagtctcagatgacaatgcagatctgacaatgccaaatctctgagtcaggatgccccaggactcagtccttggcccttctcccttctctagccccacttactcccttgctaataatcctttccagttccagggctataaataccacctatactgatgactcccaaatttctatctccagcccacgcctttctcctgagctctaagcttatatattgtttcccacttgaagatttactgattcccaacttaacatgtctaaaactgaacttttgcttcctaccctgacccatttcattcttcctagattcttccacacctcagtcaatagctcccactattcactcagtttcccagttagtcatctttgactttttttctctctcttatttcccaagcatatcaagttctaatagcccttctgttctttacccatgccaacatatttctacatcaagacccttgcacatgcagtttcttctgcctgaaatgagcttccctgtcttcacatagagatccttctcttccttcaactttccagtttaaatattgtctctccagagaggacgtctatgaatactctcttatactctctcctagcaccctgtcttttcttttcttttcttttcttttctttctttctttctttcattctttttttttgagatggagtttcactcttgtcacctaggctggagtgcaatggcactttctcggtgcactgcaacctccacctcccaggttcaagtgattctcctgcctcagcctccagagtagctgggaccacaggtgtgcaccaccacgcccggctaatttttgtgtttttagtagagacaagattttaccatgttggctagcctggtcttaaactcctgatctcaggtgatccgcccgcttcggcctcccaaactgctgggattacaggtgtaagccactgcacccggccacaccctgtattttcttaatatcacttaacaagtttgtggctatgtatttatcttttttttgttaatgtctgtctccttcattagcatgtaagctccaccagggtaggggattgtctgttttgttccctactgtgccatgtagtgtgttcaatgaatatttgttgaatgaataaatgaattaaatatatttccaacaatttattgtcttctgtcattgaattgaaccattttaaaaattgtgtattagagaagtaaagaagtgcccttaaggacatctagtccagtattatgctggacaatgtcaatgcttcattaactaatgctgcattcattacctaaggctgttataacatagtggcacaaactgagcacagaaatgtattgtctcacagatctagggaacagaagtctgaaatcaaggggtcagcaaggttggtttcttatgaaggctgagagagagaatcttttctatgcctctttcattgcttctgggggtttgcagccaatctttggcattccttggcttgtagatgcattgcttcaatctctgccttcatctttcttcacgtggctttctccccatgtctcggtctctgtccgaacattccattaaaaaaaaatttatggccaggtgcggtggctcacgcctgtaaccccagcactttgggaggccaaggcgggtggatcacctgaggtcaggagtttgagaccagcctgaccaatatggtgaaaccccatctctactaaaaatacaaaaattagctgggcgtggtggcgtgtgtctgtagtcccagctacttgggaggctgaggcagaagaatcgcttgaacctgggaggcggaggttgcagtgagccgatatcataccactgcactccagcctgggcaacagagcaagactccatctcaaaaaaaaaattattttaagttccggtatacacgtgcaggacggacaggtttgttacataggtaaatgtgtgccatagtggtttgctgcacagatcaacccattagctagatattaagccccccatgcattagctatttatcctgatgctctccctccccccaagaagattctgtatccagggcccttgagccactgctccgcccactcccacactgtggagtgtactttcgttttcaatgaatctctgctttccttgcttcattctttccttgctttatttgtgtgttttgtccaattctttgttcaaaatgccaagaacctggacaccctccacccgtgacagaacagaatagagaacccagaaataaaactgcatacctacagccatctgatctttgacaaacctgacaaaaacaagcaatgaggaaagaattccctattcaataaatactgctggaataactggctagcaatatgcagaagattgaaactaaaccgcttccttataccatatcatacaaaaattaactcaagatgaaccaaagacttaaatgtaaaacccaaaactataaaatccctggaagacaacctaggcaataccactcaggacataggcacagggaaagatttcatgacaaagacaccaaaagcaattgcaacacaagcaaaaattgacaaaggagagctaattaaatgaaagaacttctgcacagcaaaagaaactatcaacagagtaaacagacaacctacagaacgggagaacatttttgcaaactatgcatctgacaaaggtctaatatccagcatctataaggaacttaaacaaatttacaagaaaaaactaaacgaccctattaaaaagtgggtaaaggacatgaacagacatttttcaaaagaagacatacgtatgaacaacaagcatatgaagaaaagctcaatatcactgatcattagagaaatgcaaaccaaaaccacaatgaggtaccatctcaagccagtctgtatggctatgataaaaaggaaaaaaaaaaaagcagacactggcaaggttgcagagaaaagggaacacttgtacactattggtgggagtgtaaattagttcacccattgcagaaagcagtatggtgattcctgaaagagctaaaagtagaactaccattcaacccagcaatctcattactgggtatatacccaaaggaatataaatcagtctgttataaagacacatgcacatgtatgttcattgcagcactattcacaatagcaaagacatggaatcaacctaaatgcccatcaatgatagactggataaagaaaatgtggtacatatacaccatggaatactatgcagctataaaaaataacaagagcatgtcctttgcagggacatggatggagctggaggccattatccttagcaaactaatgcaggaacagaaaaccaaatactgcatgtcctcacctataagtgggagctaaatgatgagaacacatggacacatagaggggtctttcacacactggggcctttcagagggtggagggtgggaggagggagagcatcaggaaaagtaactaatgggtactaggcttaatacctggtggtgaaataatctgtacagcaaaccctcatgacacacatttacctatgtaacaagcctacacatgtacccctgaacttaaaataaaagattttaaaaatagaataaatagggttactatacacaaaaatacattattttttttaaaaaggccattttcaagagcaacaaaaaataaagcatttaagaacaaacttgtaaagcttcattgaaagacattaaagatctgaataaatcatgagataagccataaaaaaatcacctactcatcaataaattcagtgccatcaatgaataaaaaaagaaaatggggccgggcgcagtggctcatgcctgtaatcccagcactttgggaggctaaggcgagtgaatcacctgaggtcagaagttcgagaccagcctggccgacatagcgaaccctatctctactaaaaatacaaaaattagctgagcatggtggcgcatgcctgtagtcccagctcctcagaagcctgaggcaggagaatcgcttgcaccgggaggtggaggttgcagtgagctgagatcgcgccactgccctccagcttgggtaacagagtgagactccatctaacaaaaaaaaaaaccaaaccataaatgggtgtaaagtaagtaacagtagataggacattgaaataaaaataactttatgaacatctttatgccattaaatttgaacacttaaatggataattttatataaagctaaaatttaccaaaattgactcaagaaaaaatggggaaaactgaacagacttatgtttgtgaactaaattgaagcagtggttaaaatctatcaaccaacaaacaaccaccacctacctgctagatagttggttgtataggtgaattctatcagatatacaaggaacagataatctcaatactatataaactgttggattaaatctcccccaactcgttttataaggctagcataacctctatgctaaaccaggcaaagatattatgagaaagaaaaattacatgctaacttcacttgtgaacatacatgccaaaatctaaaacaaaatactagcaatcagaatgaaaaatgcattgaaaatacctatgaccaaggtgggtttatctcagtaataaaagagtgatctaacttaagaaaactattaatttacgtcaccataatgatacaaaggagcaaaactagcacttctattcaaccttgtactgtaggtcccaattagtgtagtaagaaaaggaaaataaataaaaagtaaggatcaaaaaaggagaaacaaagcttattatttgcagatgacatgactgtccacatagaaaatacaaaagtatatgtaaaatattgaagcaaggttttaggatataagagcaatataaaaaaacaatagtgtaccaattagagcttacagtagaaacaaaaactgaaagacacccaggaataaatctaacaaaagatgtacaagacctatatgcaaaaaagtataaatctttattgaataacattaaagaaaatctaagttaatagataaaatatgttcatgtataggaagacttaataatgtaatgatgcaaagtctccctaaattcatttagagattgaatgcaattccaattaaaattctaaatagaaccaagaataagcaagacaatattaaagcagtacaatataccctacccgatggcagcacttcttataagctgtagtaattaaggcagtacagagaaaaatagaccagtgggacagaatgcaaagagcccagaaaccacgtgtaaagaaaatcttaatacatgatcagtgtggaaatgatttatttaataaatgttgttggaaccactggttattattttgaaaaaaataaaatctcaaccccacattgtacacaaaaacaaactcaaagtggttttattttattttattatttttttgagatggagtctcactctgtcccccaggctggagtgcagtggcgtgatctcggctcactgcaacctctgcctcctgggtttgagcgattctcctgcctcagcttcctgactagctgggactacaggcacgtgccaccatacccggctaattttttgtatttttagtagagatggggtttcactgtgttagtcaggatggtctcgatctcctgacctcatgatccacctgcctcagcctcccaaagtgctgggattacaggcatgagccaccgcacccggcccaaagtggttttatgacctaaatgtgataagtagttacaaacttttagaagacagcatgggaaaatatcttttttttttttttagacagagtttggctctttcacccaggctggagtgaagtggcatgatcttggctcactgcaacctctgccccctgtgttcaagcgattctcctgccttagcctcccaggtagctgggattctaggcgcctgccaccacgcctggctaatttttgtatttttggtagagacggggtttcgccatgttggccaggctggtctcgaactcctgacctcaggtgatccacccgccttggcctcccaaagtgttaggattacaggcatgagccaccgcgcctggtcagggcaaatatctttatgaccttgtagtaaggagggatttcataaacaaaatacagctagataagccataaataaagtaaaatctggctaaattatactacattaaaaatttaaaacttgcgtacaaaaagacaagtcataaacaaaatgaaaaaacaagcttcagtctaggaaaagataattgcaacatgcttgcttttatcccagacccttggcaattgatttttctctgcctggaagaatactcttcattcaaatatacatctgactctcttcttcaattaatgaatgtgtctgtccaaatgtcacctcctcaaagaggccttctttgaccaccgtattgaaaataaaaccatcgtcacttcatcttctccatttgttttatcttcatagcacttattactacctgatattatatatctatttgctctttattgcatgtctccccactagaattcaaactccttgagatcagggactttgccttgctgacttgccacatccttctgtcctcaaataatgtgtggcatatactatatactaaataaatacttgttgaatgaatgaataaatgaatataagtgataaagggttagtattagaatatgtaaagactacagattagttaaaaaccaataaatggcccaataggaaaattgtcaagggcttatgaataggcagatcacagaagaagaaatctgaagatacagtaaaaatacggaaagctattttatataatttgtaatcaggaaaatacaaaattaaacaataatgaaaccaccacatcatacccaagagactggtaaaaattaaaagtttgatggtattaattattggtaagggcatagggaaaagggaactgtttactgttagttggagtataaattagcacaaagattttggagaacaattcttttttttttttttttttgggacagagtctcactctgtcgcacaggctggagtgcagtggcgtgatctcggctcactgcagcctctgcctcctgggttcaagcgattcttctgcctcagcctcctgagtagctgggactacaggcacgtgccaccacacctggctaatttctttttgtatttttagtagagacaggatttcaccatgttggccaggatggtctcgatctcctgacctcttgatctgcctgcctcagcctcccaaagtgttgggtttacaggcgtgagccactgcacccggccaagaatttgataatatctaataaagataaacatacacataccctaagacccagaaattctactctcagataatatgctagagatactttttctttttcttttctttctttctttgttttttctttttttttttttttttccctgagacggagtctctctctgtcgcccacactggagtgcagtggcacgatctcggctcactgcaacctcagcctcctggattcaagtgattctcctgcctcagcctcccaagtagctgggattacaggcatgcaccaccatgcctggctaattttttgtatttttagtagagacaggtttcaccatgttggtcaggctggtctggaactcctgacctcaggtgatctgcctgcctcggcctcccaaagtgttgggattacaagtgtgagccaccacgcccagccagggatactttttcatatctgagtcaggagaccacacaagaatgttcatagcagcattgtttgtaatagtaaatgactacatgtaacccaaatgtacaccaccagttgaatagaaaaataaaccatggtatacttatacaatgggatgctgtatgtcagtaaaaatgagcaaattttagctatacacattgatgggaataaatttcataaacacactaagcaagagaaggaaattgcagaatacgtgctatatagtttgatttctgtaaagttcaaaagatgacaaattgcaatatgttttctgtggatagatgaataggtggaagggatagtgtttacctctgaaggtggagggagtggcatgagatcagaggaggctacattgttatggcttttattacttttttttttatttgagacaaagtctcactctgtcacccaggctggagtgcagtggtgccatctccgctcactgcagccacgacctcctaagcttaggtgattctcccacctcagcctcccgagtagctggaattacaggcatgcaccaccacacccagttaatttttttgtatttttagtagagacaggatttcaccatgttggccaggctggtctcaaactcctggactcatgtaatctgcccaccttggtctcccagagtgctgggattacaggcatgagccaccgagcctggccaatttttattacttttaaaagaagcaaacatgttaagatttgacaaagatgggcagtgataatattatgacgcgagttatcattttattagtcccctagtgtgtgcttgaaaagactcatttgaaaaagtattggccaggctctgtggctcacgtctgtaatcccagcactttgggaggccgaggcaggtggattgcctgaggtcaggagttcgagaacagcttggctaacatggtgaaaccccatctctactaaaaatacaaaaattagctgggcgtggtggtgcacgcctgtagtcccagctactcgggaggctgaggcaggaaaatcacttgaacccagggggtggatgttgcagtgagccgagctgagattgcaccactgcactccagcctgggtgacagagcaagattccatctccaaaaaaaaaagaaaagaaaagaaaagaaaaaagtaccaccagttcagtaccatctgtatttgtgtgtgtgtgtgtgtgtgtgtgtgtgtatgtgagttgaaaagttgaaacagtttggtaatgctactattgtctcactctcatggcctctcccttctgtttacactgtcccagatttagggttatttgctgaacggagatcatgcagttttcaagtttgaaactcagcttaatttgggacagggatcagcaaacttgttctgtttgggccaaatagtaagtaatttggggccgtatggtctctgggccaaatattaagctttgctggccatgtggtctctgttgcaactactgaagtttcccatcatagcatggcaacagtgtggtaggcagaattctaagatggcttctgagattcctggcccctgatgcatacaaactttatctcagttatttaatcaaacactaatctaggtgctgccgtgaagggattttggagacatacttaatgtctcaaatcagttgaccttaaaatagggagattatgcatggtaggttttgcctaatcaggtgagcctttaaaagggatagggctcttcctagtaagagagattcaaaatgttaaagaggttgaatgtgagggagactctctattgcttactttgaagatggaggggccatgtggcaaggaatgtaaccagcctctaggagctgaaggtagcccttggctggtggccagcataagaatgggagtcccagttctacaactgcaaagaattaaattctgccaactaggtgagcttgaaagaggaccttgagcctcagatgagactaccaccctggccaacaccttgatttcagcctggtgagaccctgaacaaacagcccagtcctgccgggactgctgaccagtggaaactgtaagataataaatttgtgttttaagtaagccactaaagttgtggtaatttgttatacagcaacaggaaagtgatgcaaacagccatagacaatatgtaaatgaatgagtgagggaggatgtgttcccataaaactttatttattaacactgaaatttgaatttcatgtaaatttcacgagtcacaaaacatttttcttctttcaatttttttaactgtttaatatatgtgtgtgtatatatatatatgtgtgtgtgtgtgtgtgtgtgtgtgtgtgtgtgtagttagcgtgtaggctgtacaaaaaaccagtgatgggatggatttggcctgtgggttacaatttggcaaaccccatatctaggaattggtgcatttttttgtcaaacactctgaactttggaaaatttttcaggtctcataggaatacggacatcagtctctaaaacacccttttattcacgattttaaatgagttgtagctcattttcttcacatagcattgtaagcatcatagtatttttcaaacacaaaatacattttaaaataatttgcactaatggtctaaatctcttctaaatatcaaatctaaactataaaaccatttaatttatacatcaatttctagcattcaaataggttcaaaggaacattgccaactttaatgaaaatattgtagttatttatttattttatatcccccaaggaagtactctttattcttttgattgtatgattctaattagatgataaacacgcatggcctttcttaagacatgttaattagtatggatgttgctataacaatcttctggcaatttatgttttccgaatatctggtatatcatgcattaatttttatcatttaatgaaattgctaaatcaggaatttagaatgctgtgtttaaactttctttaattagaaatggagatatgaaagaaggtaggactcttggaaacaacagtttgatagcacaagatagacatgttttggggacactttctggattagtttcctagggctactgtaacaaagtagtacaaactgggtggcttaaaataacagaaatttattttctcacagttctggacactagaattctgaaatcaaggtgttttcagagcctgcccctctgaaacctggaggggagaatccttccttgtctccttctagcttctgttgttttctggtaatcatgggtgttccttggcttgtagatggatcgctccaattgttgcctctgtcatcacatggctgtcttcttccccgtgtctctgtgcatcttctactcttagaaagacaccagccatattggattagggcccaccctaatgacctatcttaatttgattacatctttgattatttccaaataagttctcatttacaggtgaggtaggagaatagggtctggaggtagggaacctgaggctgattcacactgacttcctagaaggaaatggaaaggaaaaccctaactttccacgcctaagtaacaaaaggaccagaggctactccctttgcaaatccccaccctttctgtggggcagatgggaaattgaaaatacctctgattggttgctttttgcataggattgtaactttgtaacttcagcctctgattgcgggccaagtctttgtttgcatagaagtgcaatttgtaacttcactttagcctctgactgtgggccaccacttcatttacataaggggaacaccaagtggccaatgggaaacctctagggagtgttggaccgaagaagattctgtgtcggggcccttgagcggctgcttcagcccactccaaccctgtggtgtgtaatttcgttttcaataaatctctgctttccttgcttcattctttccttgctttgtgcgttttgtccaattctttgttcaaaatgccaagaacctggacaccctccactggtaacagaacagaatagagaacccagaaataaaactgcacacctacagccatctgacctttgacaaacctgtgcattttgtccaattctttgttcaaaatgccaagaacctggacaccttccaccagtaacacaggtactggggcttaagacttcaatatatccttctgaggacataattcaacccataaccctttcacaaagaaaaagacaagaatttaagatagaataagaatgttggaataggaatgatcttaacagttttcttttctttttttttttttcttttttattgatcattcttgggtgtttctcgcagagggggacttggcagggtcacaggacaacagtggagggaaggtcagcagataaacaagtgaacaaaggtctctggttttcctaggcagaggaccttgcggccttccgcagtgtctgtgtccctgggtacttgagattagggagtggcgatgactctcaacgagcatgctgccttcaagcatctgttcaacaaagcacatcttgcaccgccctcaatccattcaaccctgagtggacacagcacttgtttcagagagcacagggttgggggtaaggtcatagatcaacaggatcccaaggcagaagaatttttctcagtacagaacaaaatgaaaagtctcccatgtctacctctttctacacagacatggcaaccatctgatttctcaatctttcccccacctttcctgcccttccattccacaaaaccgccattgtcatcatggcccgctctcaatgagctgttgggtacacctcccagacggggcggcggccaggcaaaggggctcctcacttcccagtaggggcagccgggcagaggcgcccctcaccttccggacggggcggctggccgggcggggggctgacccccccacctccctcccggacagggcggctggctgggcagaggggctcctcacttcccagtaggggcggccgggctgaggcgcccctcacctcccggacagggcagctggcctggcagggggctgacccccccaccaccctcccggacggggcggctggcctggctggggctgacccccatctccctcccggactgggtggctgccgggcggagacgctcctcacttcccagacagggtggctgctgggcagaggggctcctcacttctcagacggggcggctgccgggcagaggggctcctcacttctcagactgggcggttgccaggcagagggtctcctcacttctcagacggggctgccgggcagagacgctcctcacatcccagacggggcggcagggcagaggcgctccccacatctcagacgatgggcggccgggcagagacgctcctcatttcctagacgggatggcggccgggcagagatgctcctcactttccagactgggcagccaggcagaggggctcctcacatcccagacgatgggcggccaggcagagacgctcctcacttcccagacggggtggcggttgggcagaggctgcaatctcggcactctgggaggccaaggcaggcggctgggaggtggaggttgtagtgagccgagatcacaccactgcactccagcctgggcaccactgagcaccgagtgaacgagactctgcccgcaatcccggcaccccgggaggccgaggctggcggatcactcgcggccaggagctggagaccagcccggccaacacagggaaaccccgtctccaccaaaaaaacacgaaaaccagtcaggcgtggcggcgtgcacccgcaatcgcaggcactcggcaggccgaggcaggagaaccaggcagggaggccgcagtgagccgagatggcagcagtacagtccagcctcggctcggcatcagagggagactgtggaaagagagggagagggagaccgtggggagagggagacggagacggagagggagggggagggggagggagagggagagggagaggaacagttttctacaataaccacttacttgtatttttggagaaactgaggtatggagtgattaggagatttacccatggtcacacacagataaaaaaggacagagctggaagtggaaattggtagtgacagggaaatttacaaatgatgcaaatacatttctggtaaaacacctaaaatagtcaaagctggccctcggaaaaaagtggaaattaggcagcttatctgagtctttctcatctccctgcatttatttctcctttcttcccgttggaacctccttggcctcactctctcctctaggaacaggtggcatatactgagtgcttcttatgtgctggacattgtgctaagtcttccgtggtactatctcatttaattctcataatatagtggtaaatactattatgatcccattttacaaatgaggaaactggacttcagatattatgattctgtttaacaaatgaggaaactggactgagatgcaaacacaggcagagcctacatttgtcttaaaaattattgtataaatctaaaacgtgcaaatgcaattttgttctgtggatgtattgcacagtctgaaatccaggcttttagtgtatccatgacccaaataatgtgcattgtatctattaagtaattctcagcacccaccctctcccacccacgttcttaactacgctcttattcctattcctccttcttgccattgccccccccaccaccatacacctgcatacactttatgctttgctcacagtcccttcctggaggccctccttaagcctgccttcctagacagggttctatatttcagaatcgtctcttggactctgcctgtttcagtgatgaggtagtaaagaaagaaaccagttggctgtttgagcgggtcctcccaggggtggagggtctgttttgcaaatttgaggattcagaaactttgtcagctctcccaaaagtgttcaggtctagggatgggattgccctacctaaatttgtaactggttgattgcgaatccagaataccaatttgtggatttacactgagaaagatgcctgcaaagtgttgcaaccagagagcaatattgaaacgggagagctgcccagacagggccttgccaggggtctgatagtgagattctaatgcccatgagtagggtgctggtctctctgccaccgaagggaacaggacaaatgggccgggagtgcaggccatgggcttgactcctgggtagcagggtcccaggggctaggttgtctcagggcttttcctcaggcagcctgaggcagaaagccagatacttatgtggagaagggccaaggctgtagcaggaaagccagtgccaggacttgaattcagaggacagaaaggggaacatgaggagggaaatcagtagctcagggagatgtggccaggcaagcagtgttggattctttgctcagtctgagccttgtcttggactctttggatttaggcctgcaccaggtcatcctggtgatcaaaccccagctttctcctgagggctttggcttgacctgaccttcaggtccttggcagactgtgctgcctctggcagaagcttcacactctggctctgaccacataaatcccagtcctccccaggatgggagggttcaggtatttagccacaaatctatggttcctgaggtccccactagctgccctggcaatgccctgccaccctccactccctgagtctgccatggtccaagaaggaaaatgcaaatttccatgggtaggtttccactttggcacacgaagaaagtacaagtgagggcagagttgattccgtggctggttcagagatcgagaaaggctttaggtaaaagtcttacaagagacatgttggatttttccactgctgcttgcttttctctttttgcatcattggattaaaaaatcattagattttttgcctctgtcgcattgtctgtcacttttggacattactgcgacaggcattaacttcttattttattagtagccattaaccatacataattgatctatgtggcttctaaagagccacatcaactgcacctgtgttccagtcacctcatctgacagctggcttcagcaatcacccagctggatgagctgccctggatcagagcattgtctgttaatcgctagtgagtaccaagtacctagaactcagcaggaaatatttgttgaatgaatgaagaaataaatgtgtgactgaatgtaaacttttgtttgtggtccagtttgtcccaacattcacagaaaagcagactgtggtaactgctctttttgttatttatttatttatttatttatttattgagacagagtttccctctgtcacccaagctggagtgcaatggtgcgatctcgtctcacttcaacctccacctcccaggttcaagcgattcttgtgcctcagcctcctgaatagctgggattacaggcgttgcaccaccatgcatttttgtatttttagtagagacaggatttcgccatgttggtcaggatggtcttgaactcctgaccttaagtgatccacctgcctcagcctcccaaagtgctgggattacagacattttttgtcttttaaaaagtatacaggtgatacaggaatcattctcatcataaaagattcaaacattatagaagcatacagaacaaaatccttactactctccctcccaccacccataccctgaatcccagtcctctccttgaaggtaaccactgttaccagttcagtgggcataatttctgtctacttttcatgtatttacatacatgtaatgtatgtgtgctcatatatacatgtgcctttcttccataaataggattacattgtatttattgttttgcaacttgctttattgtatttagcaatatgtcatgagcatctttccacatcaatacatctacattattgtcaataattgcataatattgcacaacatggacatatcatattttatttaactagtcttatattggtaggtattttagtggtctacagttggtctctaatataaacactggttaataaacatccttgctatccgtatttattgtatatactttaataagacaagttcctcctgccccattattcttccttttcagcatttttctggttattctttcttattttccatatgaacatcaaacaagcttctctagtccccagaataggcagttttactgggatcatgttagatttgtaatttaaatgaaagagaattgacctattttgatgttgagtcttattattcatttatttatttttaaattaaattgtattattttgttgttgttgttgttgagacagattcttgcttttgtcacccgggctggagtgcaatggtacaatctcggctcactgcaacctccacctgcctcccgggttcaagcaattctcctgcctcagcctcccgagtagctgggattacaggcgtgcgccaccatgcccggctaatttttgtatttttagtggagatggggtttcaccgcattggccaggctggtctcgaactcttgacctcaggcgatccacctgcctcggcctcccaaagtgttgagattacaggcatgagccaccgcacccagctatctttccatttttgtctgaagtttctaaaaatattttattttaaaatcattacaaaattaataaatgtctgttgtagaagctttagaacacttagaactgtatacattaaaaattatcagctttctgtgcccccctccctgcctcccggtttcctgttgcccacaagtaaccactgttatcaggtcatggtctccctcacgtcttcaaaaataagatcatgctattcctgtgatctgcaacttgcttttttcttaaaatatttcccaagtagctttccatgtcagtacacacaatgctgcctcaatatttttaaactgctgcagtttattaccctctgtggttatgctagatttttaaaaaatgcaatgccttgtgatagacatttgtgtatgtccaaatttattataaaccattttataataaacaaccttattatatagtgtcatgcacattatgtgattttctgtaggataaattcccagcagtggaattactgatgtcaaaagttattgtgtatttaaaattttaattgatattgccaaatcacactccaaaaagtttttaacaatagttaaaagacagtatatgtttttctaaaaccttgtcatcactagggctattaatctttttaatatctgccaatctgtagttttcatttctatttcttaaataagtgtcaggttgaacatcttttcatataatatgtttgctggtaatttgtaacttgccttctatgatttctcaattttcatcctttgtcgatttgcctgcctttttaatcttattaattttatttatttatttttttttgagacgaagtctcattcttgtccctcagactggagtgcgatggtgcaatctcggctcactgcaaccttcacctcccggcttcaagcaattctcctgcctcagcctcgcgagtagctgggattacaggcacctgcccaccacgcctggctaatttttgtatttttggtagagatggggtttcaccatgttggctaggctggtctcgaactcctgacctcaggtgatccacccgcctcagcctcccaaagtgctgggattacaggcgtgagccactgtgcctggccaatcttattaatttataacagtcctttgtgtattaccaatactagtcatttgctttgtatatttgttacaaatactttccctatttttatgcttcttggctttgtttatgctgtgttttggctgtttataagtattcaaatgtcatacaggcaaatgattaaatcttttttatttttgattgtagattccaagattataaaaatattctcctggctggggcacagtggctcacaactgtaaccccaacactttgggaggctgaggtgagtggctcgcttgaggccaggagttcgagatcagcctaggcaacacataacccggtctcaa

SEQ ID NO: 3668 - DNA, 37294 bp, human; identical to SEQ ID NO: 3667

SEQ ID NO: 3669 - DNA, 37294 bp, human; identical to SEQ ID NO: 3667

SEQ ID NO: 3670 - DNA, 392 bp, human
tgtccatagttcgtttatccgtccatgccaaatggattatggggaaggtgactgggacaaaaatgcaaaagactgctaaagtgagagtgatcaggcttgttctggatccccatttattaaagtattataataagcaaaaaacgtactttgctcacaatgcccttcagcagtgcacaattggggatatcgtgcttctcaaagctttacctgttccacgaacaaagcatgtgaaacatgaactggctgagattgttttcaaagttggaaaactcgtagatcctgtgacaggaaaaccttgtgcaggaactacctatctggagagtccattgagttcggaaaccacccaggtaagcaaaaatctgaaagaactcaatatctcttcagcacagtga

SEQ ID NO: 3671 - DNA, 37294 bp, human; identical to SEQ ID NO: 3667

SEQ ID NO: 3672 - DNA, 4826 bp, human
cgtcctgagcagcagcccactccctgtcccctgcaggcgtccgacccgaagtccacgcgccggaactcggaccaggagccagaggaccccagcgcagaatccgcggagacgcacggcttcgtcgaccacgctcccaggtggcgttccagcccagatccggccacgaagacaccggcgacctcggcctgggtttcctgttcgatgagctccagaaagaagacggtcagtgcctgtctggggacccgaaccggtgatttggtgaactcttggaaagcaactttcccggagagaggagcgtgaacccgaggctactgcgctgtctctctcagccacgggtctaggctgccctgtgtctgggccaaacgccctgatctctctctctctctccagctctctcctccgacctctctttccctttcctcctttccagatgcgaaggatatagagacttcagtgactgaagctggaggagacgatgagaagaaaatacggaccaaacccgagcagggagcaggagcaggaaaagaaagtcacgtgtacgcgggagctgcggaccccatgatccacgagaaccagaagggcggtggtggccaccaggagccctggcagcagcagcctgaggagttggcccaggactcctccgctgaggatccgcaaccccaagatcaggagcgtctattcagccccagcacgttcggcgggttgcacctgaaggagctagacagcattttctgaccttctcaatatccggacatgttcgcttggtaagcagcttgctctggaggtgcccagttcccaggacgctagggctcttctagggccgcctttggctctgccccagtcgccttccctctcctccaaagtcaaaagttatgtagggggctcaaggcccctggctatgtaggggtcccaaggccacaaggcccaaggccacaaggctaagtatggggctcaaggccgctcttgagctgtggggcgggggcgatgcctactgggcattaaggtatttttcacacagtgtatcaacgaatcaaactgggaaactttggctagactcctgtttttgtaaatgttttattggaatcgcgattgacatcagcgtgaggaaagtgagtcctacaggattggatcttgcctttattgaaaattttgacaatttggttattgtggattttttttcatcggtcgtgatttttaaaatatttgcattaaaaattattaatcttcgggctggtgggtggctcacgcctgtaatctcagtgctctgggactccaagtcaggaggatcacttgagtccaggcgttcaaaaccagcctgagcaatatagtgagactccatctccacaaaatattttgtaaaattagtggtgcgtattagcaggcacctgtagtccaagctactctgaggcatcgcttcagcccaggagttcgaggtttcagtgaactgtgatcatgccactgccctccactatgtgccacggagctagaccctatctctaaaattagatacatagatagattagatagatgatagacacatagatagatacatagacagagatatcttgaatcgtgagtgttttagtgctctcttaaattctgcacacaggtggggcatgatggctcatgcctgtaatcccgacacttagggaggccgaggcaggcggatcatgaggtcaggagttcaagaccagcctggccaatatagtgaaaccccatctctactaaaaatacaaaaaaattagctgggcgtggtggcgggtgcctataatcccagctactcaggaggctgtggcaggagaatcactttaacccgggaggcggaagttgcagtgagccgagattgtgccactgcactccagccagggtgacagtgccagactctgtccaaaaaaaaaaaaaaaaaaaaaagtctgcacacaaaggacaaccattcctacctaatgcaatcctggggctaggtatcacagaaaaatgtgctggagcggttgcgaggatagataatttcaaaccggtatgaaatgttcataggtgtatttcatttcatccacaattccaaataatgaacttttgtggtttttttttcccagaaagcaactggcaatatgcatggatgtgagtgaagctgaagtggaagccagtaagcctgatgaaagcaattggtcagagtagccactctgaaacctgcctcagaccttggatactttgtcctacacattctccaattggcctgtatgtgttgcctttttatgtttgcgaagtgagttttgaattttagggggtgaaaagtaggatatgtaaacattagcttgtggaaatttcccattaacagagggaatatgctttctaatggaaaaataaaattaaacagaactgaactgctactgctatttcctatacaaaattaagataaagttcaattccttctaacaatggtaacctttggagaacacttctgtatggagttatgttgtgactgagtgtgacttaagaactacgcaaattaatgcaccaaggagccaggatgtgagaagtttcaattgtatttaaaatatttaaaccaggctaccttcttagctaaatgactgaatttataaatattcaggcattggggaaagggagtaagttacacagagagagaagacactaaatgagtaattaatgtatgtttagtttcactgagactgatggggaggacataacttaaaagtactcttggctggtggtcctgctgttgtttttaagtgtctgatgaggccatgcagaacgtggcagcacttaatttaaattttctggaatactttgatttgtaagcgtgaatgctctgctaatatacttgcagtacagtgggggtgtgggggggcaggttttcaaactagaaatttgcctaaaaattggaataaacaagaaaaattttgaataaggttccactcaccttagaaagctgaaaaggttaaaaaagaattgcatacactcaaatatatacctggaagatacggcacaaattgagctttgtgagggaatattctcttgaggaatttctaacaactaaggagtttttggtattactggtttttttgctttgttttgtttttgtttttgtttttgagatggagtctcgctctgtcgcccaggctgtagtgcagtggcgcaatctgggctcactgcaagctccaccttccgggttcctgccattctcctgcctcagcctcccgagtagctgggactacaggcgcccatcaccacgcctagtgaattttttgtatttttagtagagatgggttttcaccgtgttatccaggatggtctcgatctcctgacatcatgatccacccgcctcgtcctcccaaagtgctgggattacaggtgtgagccaccgtgcccggcctgttactgttttaaactggtaggttttatgaaattttttggtggggtagggcacgctcaatttagacccgaatgtaacctatgctaatttgaaatagtttttcattttcccaggcagtgatgatgaatttgtaggtcatgggatcaaaaagtcactaagataacttaagttttattaagagtattttttcaaaacaagaagaaaacccaggatgagattatgagcctcgctctgcagtttgtgtgagtgcagtgatggaaaggagctgcagaactagtgctggtgacttttagtgaatttagacctagtttggccaaattttccttaactctgcaggctaaaatatcaaggcaatatccagggcatcaggactattctgtcccagctagacaagccacaaactctctgggccccccatgaccaagcttttttttcagaccatccttttcagtttcaagatttttcagaggatgaagtctgggcccagtggctcatgcctgtaattccaacactttgggaggcagaggccggtggatcacttaaggccaggaatttgagaccagcctggccaacatggtgaaacctcatggtaaaaatacaaaaattagccagacgtgctgggataccactgtagccccagctactacaaaggctgaggcaggaggatcgcctggacccgagaggtgagccgagattgtgccactgcattccagtctgggtaacagagcaagaccctgtctcaaaaaaaaaaaaagttttcagaggatgaatgaccccttagacatccttgaggaaacctgattaaaaatccaacctgctcctattgatgtagtcacctcagactgaagatggccttttcaaatggggggccttcccaccctataactctaaatggggcccaccatataccttgctcaactatcaccactaccagggtgacactattcctaatgaagagggagtagaggcagctagacaccccaatggtccactgtcaggatactgacatttcttcatcctattaccaagcatagcgttaacagcagatacttagtgcagtttgttcactagactcatatccaggagctggaaaaacccttaaagaatattaaaaatgggaggagagagaaacaaagcaataagcataatccaaaacagaacggaaggcaagggggtacagcattaagtttcctaaaatattttaccaataagaactggcctccaatgtaaattagagtttctgacctctatcatttttcttttctttgaaaaacatttaacatttattgcaaggcagttatactggtgacaatttctctcaattttgtttctctgaaaaagtctttatttctccttttctcaaagggtaacttcaccggatgaagaaatctaggttgttggtgtttttctttgaacacctcttcttgctcttcgatag

SEQ ID NO: 3673 - DNA, 4826 bp, human; identical to SEQ ID NO: 3672

SEQ ID NO: 3674 - DNA, 20259 bp, human
tccagaactctcacccgattgcctgcctctgctgcgtctttgcccactgaacagccatgagaaggcaactccggtccagaagggctccatcctttccttacagttatcgctacagactcgtgagtgccagagagcagaatattttgctgccccctccccttttattttaatggggtgggttgggggctgtgtagaccttggtttacggctgcctctctttgagacgggcagaaacagcgaagtttaggggagcccagggtttcaaaaaggagcagtgactcccagcacccccgggcaccctaaactgctggataaaaggaggaagcccctcttcctgtgaaacaaagataagggaaggagaagataacagagaataagtggcttctaaaatcttttcctgggagtatagaattttcacagaccttttggagtataaaagtttaattctaatagcaagaaatttagccaagagggaaggaaggaggaagaggaaatgaaaggcactgcctacccagctgtctcttgggtggtagcttcttagagtccagctgctctctttctaaagtagaaattccaaactatagctaaaatcatagaatccccaataggagcagggaggaatcctagacattatctctccagaacccctcattacctaaaggaggctgctgtggctcagagtacaggagtgacttgcaagttagtggaggagccaaagtgaaaatgcaatatcctcactgctaatcttgtactctttccattgtatttgcagaatgcatcttccaaacccccgatctgccactacccattgccatcctgactgccaccccacactgcccaacatgtagacacacatacattcttttgtctcatcatttatttccagggtgtattacaaattatttgatccaaaagtttatttgcatttattttgctataagtcattaatgtatgccacacgcagtgctttttggggagaggattttgaaatgttccccagagaggattgtgatctcagccccaggaggaaacaaagcctaagccatttttctttgggtatggccacttatgtaaccagggagttaagtgaagactgtcaacagcccgcagaagaaaacacacattattctaacctcctatcaatctacagagggcttctcttagctttttagccacaatttgaagaaccgtttaacttcccccaaagtttcttccagctctcaaaacagttacaatctgcaggggtataaaactatttcttacttgccttcttttctatgtaatcttgttaaaatgttgtgtataatttcagttatttgttaagtggcttggattttaaatgcatcaggggatcttgctctttataatacttgaccaaatttaaaaataaattaatgcaatcctgtgctaatttctcttttaaaattaaccagccattcaaatgtttatggtgtataaacacatgccttgctgtcttctttgcagagcacaaatttaaaatttatcctttgggtcatactgtttgtttatatatttgtttatatgtttatatatttagattactcaaaatggagctaccctctgttcttcagactcttccctttcagggaaacctgatgaccccatcacacacccactaccatatcccagcacactcacacacactatcacatgagggtagtgccactttaggaaagtgacaagacagaatcttagggataagcattctcattaccaaaggattttctattggattttgttaaatagtttcacaaagatacattttacacaggatttaattaatgaggatcttttggggaaggcctctcttgcacagtgtgaccatttcctttacctggaaacagaggagaggagaaaagattcgaggttcctaaagtaaagctcaggaacctctcacagcctctcgggtgtgagagctgtaggggcaaattagccgtgagaagattaattcttctcaggagggtaaagctttaatgacaagccatctgtaatgggattatcatgagagccaatatctacaaataagatcagtctgaggcctaggccagctgcctcctctgtggaaggttaaaggcaggcataggtaacatggagagaaaagaaaattgttcaggaaatataaagggaatatatatttctcctcaatgaaatgttatacttcaaattcactgagattctcaggtgcagtagattctctgggggccatgattgctacccactgtgatatacatgacagctcagtcagggtgacaagctctgtgagagcattcccgcagagtcctgcatcaggaattttaagtcaggcaggtatcactgatatttggttaggacccactgggtacttaactgtcagctttacactgtggagggccatcgagaggctagaaaatatggaatctccctctgggtgctcaaaatgtagtttgggagtttaaatgtgtgcataggttcacacacaagtgaaagatatttaagaacaggtattaatccattcatcattgagtgatgaagtttattttcctaagccttacactgtgagcctatgtcagtcagccatccttgattataataagcacctaaaatctttttttgtgtttttttgagacaatgtctcactctgtcacccaggctggagtacagtggcatgatcacagctcactgcagccttgacctcccaggctcaagtgatcctcctgcctcagcctcctgagtagctaggactacaggtgcatgccaccatgcctggttaatttttttttaattttgtagagacagggtctcactatgttgctcaggctgtcatcaaactcctgggttcaagtgatcctcctttcttggcctcccaaagtgtcgggattacaggcttgagccctaaaatcgtttaggaacacagaacctaaggcactgtgcttcattaatctactaagctacctctaggcacttgtgctcaatgtgatagaggagaaacatcattgtccagggtatcaagagacataggttccgagaccgtcaactctatcatgaatttactgcatggttttggctagatcctgtcccatctctgggcctcagatggataagtaaatcttgaaggtctctgtcggttctgatgtgatattttatatagagctgtacattggaacaaattagagagcaattcaagagggcttataatcaagagctagatagtgctgtgcagactgaatgctgagagctgagccttgtcattctgtatcacttgtactgattctgaacaatccaatttgctgagccctcctccccccaacaaaggcagcatttttagcagggtgccctctaaatggcctttgaggaatcaggccgggagggggcagcacagagcccctggtctctagtgtttgacacatccaacccaacaggtgcacagccccgcaactcttcagacttggacagcagagaagggagggcagcctcattttctgctgctgcaataagccttggcaaacccccaaagagcaaagatacaactctctggcctgtggctgggaggcatttgaaacaccacttggtgaagtctaggtttctctctccctctctctttttcagtttaattttcttagaaccactcagagaagattacagtttcaaatctcaagtaatggctgcaatcagtcaatcaacaaatatgtgctgagtatgtattacgtgcccagctttttgcctaagcatagggggagactaaggaagcccggggttccagctctcagatggtctttccaaccaatttaaggtaggaagagattcaaactagggcaataatcagagaagcagctaataactgcccatctattgtttctgttgggaaggaaggctaagttttgaggaggggtacagcagttggcctctcctcctgatgtccgtcccaggctatttttagacacaacttgaaatggtgaagttgagcagctgaatgtgtacagggtgttaggataaagctggcttggactgaaagtttgctatcacagacacaatgtctaagactattccatcctcttcctgtgtgagctcacctctactctgataggacaaggttaagtgggaggtcaaggccccagaacagagtagtgatatgagcagtccttggagaagagcccaaatgcctgaagctgagaataaaacttgcacctctatggaaagaatactgagtcaaaatgggtcatagaaaggatatttcctccaaaagaactagggagaaagaaaatccacctcttgtaacaacatgtatgtttatgggaaagtggaaatttgaagcatctccaaatattgagtcatttcgatttatttttggctggtgggatgcaccattgtacattttttttcaaaaagggtattgtgttttgtcactgttccaggatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagtaagtcccaatagtcccaatgccaaagtctggtgtcctttgcttttggtgtggtgttcagggctcctttaccatacgctggatgggcttgtctgcaaacttctctttgcacttcatgtaaaggcatcaatgcctagggaaatgcctagactgtggacagattccatcagaacaaactccaaatggatgaacaaacttgattgtgtaaccaaaacccactgggctcaacatcagttgcaatgcagagagacagtgagaatgagttgaaaaagcacatgatttttttaagtcccagtcctgtcactttctatccacgtgaccgtggactcatcatttcccctctctgagcctcagtttcctcacatgccaaatgaggaaaacaatccctgacttgcttctcttacaggatcagagtgaggccccaattagatgttaaaactgtaaagtttaaagaactatgcagaagacttcttgtaagaaatgagactcaaatccctgctaacatgaccaagtgtttttatgaggccccatcacctggtaatgtcagagaaggagagccaggaggcgtgtccctggccccagcttgtgggtgtcttcttctgctatgatagagatgtttgatcagtggcagaattatattccttagcatttcctctttgcatcacatgctgccattatttttactccacaacttcaccagcactcacctcctacagtcttacccacccttaaactattaatgctgagccttctcctcaggagatttagccagtggtaaaattcacacttgccacagtctctgcacagcccagaaaaagagcagctgctggtttggaaatcagtcaatccacagaagaaaaaaaatagaggatgccaaggatgaaataacagtcccctagtgccaagggtctaggttgctgaaattgatggccatgtcttctaaaggccccgttggctaagaattctctccctcaaagttaatgttgctaattcagctcagtcaaggtgacacactaagctctgtttcctggaattaggaatagcacgtgggatctcccttcacccctccccaattcccagccccacccctgaccatcccacaaactctcaactggaacaaatgtaccatttaaggaacattccgacattctggaagttgcagacaaatactggacactcacttggggctccaagggtgcacagctgtttctcccttgcctaaagaggactggaaaaacaagccttgtgaaatgcaagtgtgaatctgggagggggagcctaaacaaccagccattagatcttcaccagatgagctgatccaaattgcttctgtggaaggcaatccataggccaataagtggggatgagggaggaaggttcaagtgcccagagaagatatggcaatagggacacagcatgataggccgtagccagacctctgagtagcagatctaagtagagcccaggaattcatccactgggctaccctgggcaaagggtgaatggtaatgttaatgcttcagccataaagcacacgccttgctgtcttctttcctgagaacaaggtgcccgcttgtgcacttactaatgctgtcccaacctggacatcaacctgcccaatatatttaccaggcctatgaatataatctgggcctttcctttggtatctacgcaacccctattcttggaaactctatgttattttattggataccaacaagaatcatatgaggtagtaatattattatccccattttacagatgcagaaactgaggcttagagagggtaagtaacttgcctatagtcatatagttactaagtggcagtgctgggattacaaatcctggttggatgaacaccaaagttcattcttttgccagaacactgccccatttcatgaactctaacaatgaacaaggccctgatgtgtagggcctcaggacttgacacggtgttttagtgggagaaatgaagagttgggagcacggttacttagtggtctattcaagcccgggtggggcattgaggaaagaactctagagtacctagaggaaagacccaagtaatacttggacatccagggcagaaagtgtcagagggatcaatgggttcaaatggggactgtgcttggttttacctgggggtggctgagctagctatctcagtctgtgatcacctatcataaactctagggcgcccactcctgggtgaggctaaggggacttactgctagtgtcattctcccatctacagcttcctggtcacacatcctgggaaaaaaggaagatatctccaaaggaatgtacctatgttccattgctttcccttcatccatgaaactgagtcttttgatctccatggatggctctagctgttgatccattcctaggacagggatggggtaaaggaatggaggcagaaacacagggcaaatgccattagatagccagtgggcaacagccaagtatcacaggcacacaggtgctgtcgtttattctccagggactccaactgaatcaatgtgttcatgttccagttctgctttagttcatctaataaaataaaaagggtcagttccatttccagtcggattactatgggttttttttctcccttccacaacaccttttttggttaattttatttggttcatggttcaatttaaaaattaacatttggattcagtttggggtacagcaaagttaagtggtttgttccagtttctggttcataattcagttcaaatctgtaggtccaacatcatgtcatttctgtgagcagagccaaacattgttgcctgagagagccccaaggagggcttgaaaagagtttctcatcagcaatctcatactcattcacttcactcagtgttgcctaatcctgggacaaacctagtcctaatacagcccaaagagggaaaattcacacaacggtcctacagcactaataataatgttaataataactgatgatgactgccatttatggtgcaattagtatttgccaggctctgtgctatgctgcttatatgcattagtcaatgctaagaagtaagtaccactattgtacagacgaggaaattgaggcccagagaggtgaacagcatgtccaagattaatcagcttggaagtggtgtagtcaggataggacgttaaggaaagactgaatttcagatattgttagggatatagataagaatccgaggtaagtgctatttttatccccatcttacctgtgaggaattggaggtgcaaggaagttctgtaacttgccaaagttcacgggcaagtgtcagtgattaggtactgtctcctccttttcccttccccaccctgtgttagtgttctttttgaaaagcagagccattttattcatctttgctaaagatgaatacaatttgaaataagcaggccaaaacctcactttgccttgattggaggcaagtccagtggaaattcatcaaaagtttgaattatagactatgtggaaagaaatgctgttttcatcacttcaaatacctataattattggaaccaagctgctaggactcttcagggcacccactttaatgaatagcaaagaatgatttgtacttaggacatcaactgttgcccagaggactctcaagcaattttccctctgcaatacttttaactccactcccctgtattcttgttcatggccatcatttgctgagcaagcccttccatcggagatgctgtaaaggtaaactgcaattagacccctgacacaatcctcactgactccaaattggtgaaatctgaataagcaaggacatactgaatctgaggaattttttaaagagctatttcgtggttgggtttgttctggttcatgagtccaagcagggaggaagagcttgttggcaagcactgaccactctcatctgtgattgctctgcaggcctgatcttactcatttacttcttcttctatgcctccttggctgctgtgatcaccctctgcatgtacacactatttctgaccatcagtccctatataccaaccttcacggagcgggtaaagcctcctggtgagtgtgcccagatgccctgtgttgtcagaacttgctggacagaaatatgcttgcacagcatgttcagcctcaattaactttggctcttcctggtaatgacttagagattcaattattaggaggaaaagtaaaatggtacttggcaaattatggttcttttcattttgattgcctggggggaaatggtttcatgggaatcaatacaaaaaaattatcccaagaatgggttaatatatccaagacctgttttcattgccaggagttatgatcagacccttcgcccatagccttaacttcaacttcaacgtttctgaacccgacacttggcagcattatgtgattagcctaaatggctttctccagggtaagtaagttcgtctgaatagtggaaagctcttttgaaaggtgatgggtgggaatccaaaattcaaaattcacctggcccaggaatcccagtcttactaaccccaactcatcatggtctgtccttactttgcatcccccttagcacctgtagctacaatcagaattgctctagtgtgtgattgtatgttgtcttgaaaacatacaagccaattttccagcaagataagctctttgtggcagagaaattttttttcttgaacacgttacagtacccatttaagccctgaacatatccagatggctcaataatgatcatttatagaagataattcttgggggagatagtggtgggaaaagaagaatgttctccagagctgaaagattcctatcttctaaactttctcaaggtaaaagaagtcatttcttggagatgggttaacttgaagggagagggcaagcgtctttattttatttgagatggagtctcactctgtcgcccaggctggagtgcagtggtttgatctctgctctctgcaacctctgcctcccaagttcaagcgattatcctgcctcagcctcctgagtagctgggactacatgtgcgtgccaccacgccctgctaattttttgtattcttagtaaagatggggtttcaccgtgttagccaggatggtcttgatctcctgaccttgtgatccacgtgccttggcctcccaaagtgctgggatgacaggcatgagccaccgcgcccagccaagtgtcattatttaacagcattccagaaaggagttagaggaagaatctctgggtggcagtcgctccaacattctgatcccaagtattttcgaggtgcctatctctatagtgtcatcagataagttttcaggggcaaatgaatggctttgtgggagacgcttccacaaggtaaaatctgaggtagcagcttggttaaggttaacagagcacacaggttctttatgcagctatcaaagaggagctccagtggggtttgcatttctgcacctaatctttgtggggaaaaaaatgccagtcattctggcttggttgtcctggcctggttgaagtggggttgatccattctagaggcggctactattataacaagtgcactgaattaggaggagaacaatctcttatcatgtgctaggaggtgttatttaaatacataaatttggtcatttaactttaactctgcataataaagttgatcacgctcattttataaatgagaaaactgagactcagaaagggggagtagcttgatcaaagactctggcagcagaaccagtgtttgaatccacatttcttgttctttacactctcgctgctataagtgttataaagggaccaacaacatgggcatctcctgggagtttgttagaaaggcaaaatctcagaccacattctagacctgctgaatcaaaatctgcatttttaaaaaatccacaggtgatttgtaggaaatttaaagtttgagacatgctgcttttcataattctacgctgctgtcacatgaccaagagttagaaattcagctttatatcagtaaggctcagtgttattttgggtaagtctgagcttcagattccttaccagtgaaacgaggggagacgggactgggttctttctgagtccatgtagttctatttttagctacagaaatgttttgggcatcatggccagcacagtatcttcttttgtttcagaatgcttgcaagcgattgcaaatatattgccggattccctgctaagaaaatccctccaagaagctagtagacagagaaataccaattctgacctgatgatgatggaagcaggaaatgctaggaaaagcactagtttttagttcctaagagtagataatgtgtcctgctaaaaagaagcacatctctgaaatagacatcacagagtatcactttcactcccatgaggactgggattttgcaataagggtcatgtccatgtcacattatttttaatggaactacctcaagagaaacaatgagcacatgatcgcagcctctatttagaaagttatttgagcatagttcttgctctaaaaaaattaaaacaaagccttgaattaaatgtagctttgtcaaagaaaaaataaaggcatagccatatttggaatagatttaaaattcgcagttgccgattaataatatcaaacccaagtcacaacctgtgggtttgatattattagatgaggattcagcagcacattttgagttttacctctggtagatcacaggtgcaaaatctcctctgaaatactgagctactttgaacattaatacatagggactgagtctaacaggactaactgggctccatcatttagaatcaaattggaaataatgcagtaatttctaaagcccagttttatgtatgaaatttggtagcccaaagggttacctcacaaatagcccttttaagctttctccctgatatatgtatccttggacacatgttacattccatccaatgtaaaaggacatttatcctgaatgtctcaggcctcagttgacaagatctcatgccctcaccatccccgtagagaccctgtggttgtcattggtttctatcttttaacttatgcttctgttttgcagtgctaacttccctctgtaaaggatgaagagctggcttattccctcccccgcctcctcctcctgctccacctccttctcctcctcttcctcttcttccactttccttctgtctcacaactcatacttctcactcttacaatcaggtgcctctcactgacttcaaagggagacattgtaactgcccagcgggttcaccttgcccaccatctagacagagctgatttatcaagacaggggtattgcaatagagacagagtaatccacacccagccagctgtgcgggagactggatttttattattactcaaatcaatctccccaggactatttctctattgcaatcaaatccatgtacattgggtctgcagtgccccgccagtggagacagtaccagagtcggcctccagcccaagagaactaggtggctgcttgggctggcctctggatccattgccaggtcgggaggtggggtgctactgaaccacgagcaggtagccataagggcaatcccaaaagagcccccagatttgtaactgcccaatgggttcaccttgtttcctaagtgaagttaaggagatttaacccaggatataccatatatatacccttatatataccaggatatacccttatatataccaggatatataaggatatacccttatatataccatatacccttatatataatatatatatacccttatatataatatatatatacccttatatataatatatatatacccttatatataatatatatatacccttatatataatataatattatattatatatatataatataatatataatatatatattatatacccttatatataatatatatatatacccttatatataatatatatattatattatatataagggtgtatatatatatattatatatatataatatatatatattatatacccttatatatattatattatatataagggtatatatatattatatataagggtatatatatattatatataagggtatatataagggtatatccttatatatcctggtatatatatatacccttatatatacccttatataccataccttgaatgtttcagtccctcttccaaaatctaccaactatgtgcctatttctctctcagaagtagaagggacagccttccaagtttacagtttatcatgtctgaaaagaaatggtggaaaatagagaaaatttataaagtgactgacataggacccagagatggatatccagaagttccatgggaatgaaaagcaaaggaacaggcaatcaaactgggctgaagtgactagtcaggaagacttcctagagggatggctgccgatgaaggctgttgggcacctgatgccaggtcacaggtagactgagtgggctttcagaggagtacaaacaagctggagaaaggaaacttgggagggaggactactgaacgcacggccttcccctgtagcacctgtctaacataacctgttgccactcacacatgctttaggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccgggtatattggcttttcatatctggtggtgataagcgaatgaactagataggagggctctggccactccatttgtcttggtctctgtcttcacacaccacaggtttggccatttttctgacagtatcataaatacaaataaccagataaacctatcaatttcttcccccccgcccaccgagcacttcctatggccattcttctccctcacccccaaacctgtcacttgatggcctttgtcaagaatggggtcctagtcaagtgcagtggctcgaggttataatccaagctactcgggaggctgaggaaggagggttgcttgagcttaggagttcaagtttaacttgggcaacatagtgagacttcatctttaattttttaaaaaagtattttaaataaagaatggaatactgagctgtttggaacaggggattgaaatgagggtggcatgggggacagttcttatatcataaaaatgcatttttcttccatcctgtcatgacttaggtgtggcagagccttatcagtcacacctctcttgaaattagaaagttctttacatctttagcattgacttgctgacgtttccccttgtgtgtaaataccaggcataaatacaacacggagtaagctgagctgcttagctctgaagatgtttttcattttttgctttttgtaacatttctgagaaggcgaaatagatgaagcatatgcctgaggaagcatgactgggaggaaggttagaaaagcccaattttttactgtcaaatatgttttgttaaaaaaaaataaaacactggttttcttttgatagattgtaggctttcgtcctgagcttggagatcctgtgaaggtttcctgcaaagttcaggtaaagagtccttttgagtaagcattgttagcacatctgtttcatgcaaaaaggtagtccatcactttcaaggacttacacatggatggtaggctaaggaaaaggttaatcttttcataactacacctctctttagttccttcaggttttcctctttccagaaagcattcaattcatgtgtgtttgtgtgtatagtgtatgtgtgtgtatgtgtgtgtgtcagtcagtctgtcatgattaatacttctgaaaaccaaagactgaacttcagctaagggccacagcagggaacaacaatgtgccaagtcattaattgagattctgtttacacttttgcttttagctctaattacttgtttctttgaactaaacaaacagctttcattagagtcattagttcccagattttaaaactgaatttcacattttgcagcaatgaccagtggtactgggtgttgcaataacaaatgactacatgggaagtataaacagaactcgattaatatgctaattaactgtccttcgagggaccattaacttctatctcatctgcaccaattagctcccttgtaggaaaaagcccttagatcttgggtttgcttcttaaacaggcagtagctttctcctgttctatgacatcaactgcacccccagacctggatagttgtcttgcaaatgcgtgaggcctggtaatcccattctcagtaggagaaatacagttgaaaacttcagtcttcatggtgacagatcagaaaacagcaaaaggcagcagttattcagccaatatcccacatttagcaagcatttattgatcacttattatatagcagatcctctgctaggtgttagaagtgtcgaggtaagagtatgactccgtctctgaaatcaagacaatcaagtattacatgtgctgtgaaaagtgaagatgagctctgaaaggtcaggcagtacttgccaaatgaacaaggtaggaagcacattctgttctcatgtatatgtgtaaatattcacaacatgaggtgacactacaaactatccgaactgattcctcaggccttcatgaaaaataaatttcattgctttttagaagaatgtattaaaagtaaatcataaagaccaacttagtcttaagttagcatattaactggacagagttctacttattgttccctaatggaagctgtttgtttttcagcttacatcaaaccttgctaagaactgtcctttctaaaattgttttaatgttttaattattatttttagctacctccttacatattttatgtccttttaaaaaatatattaagaatctctatacattctataataaacaatactggtcaaatccacacccatttgtgaaaatcaagcaggatgaggtaatgactagaataaattaaggagagcttagtttgtaccaagaacaattatagtatattgacagaagtaatcacatgaccttagtgagtaatttgctagtagtgatgcactatttgtccttactagcccccagacctctgctatttagggcaagccgaatgtatcacagaatgggcagcccctacctgacataatgtgatgagtgtagatctgtttactttaatcatttccatacccaggctcttgttgcttacccctctgaccccacctactgtaattaagcactacagagaatatggtcagagacatgagtctaggtgagccaactgtaggctgtgtgcctgtgtatcaggtacctatgcacttgatctgacttccaatagaaccgagcctgcagtgtgcaaatcgtggagtgggatttactaaatatgttctaacgtatatcttcctcagctccaaagtccaagactgggtgccaggcccagtgtggttctttggagaaaggctggagttgtaggtcctctttccagagcagcatcaggtactgcaagccctttggattgcttctgtctgggtaccccagaagccaacagagagccatactgagcacctttgtcctcctcagttcaggccttctactcaatattctttgaactgaaaagacaaggcacagtcactccctaaaaatgctcatctagggacaggtcacggctgagctctgctccattctgctttcatggtcttcctggaacagttggttatggttcacacagtgatttcacctgggtacaactccctttagctcagactctagcccactctgtgacccagcaccccacatatacctgcttttgcttacagagaggtgatgaaaatgacatccgatccatcagttactacccagagtcggcttcttttgacctccgctactacccttactacggcaaactgactcacgtaagctgtattccctttagtcattgctgtcagaaagggctcagtgacaaaagaagagctggctgggatctatgagaattagggagcaggagatagtagaggggtaaatagctgctggccataaccaggagctccctttaccaattcttatcacaaccacactcctttccatatctgaaagaatctcatatatggcctaatttaaccttttaagtttacgaatgggaaaattggggttcagagacagaaagtgacttgcccaagaccatacagctaagttagtggcagggtcaggagcagataaattactaccaatgtgcttaaacatgccctaataatcacgcttctgtttctcccatttgaagcgctggggtgagtccccaacacagggactcgatagacactagttttggtttaattcatggtctgatttccagaaaaatcatatcatgctgaatcagaattggtttttcccagaggacaatcagatatctgacagtgacttgttagagaaatgtatgattttcccacactttcccactgcaaggagagtatgtctgttgctttggccatttgcaaattggcatcatgggatttactcagttctctttgtgagggttgtcatcctgcagtgattatctgatcacttccctcctaccacctccccacacttagaattcatttttcttctacctgcaggttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaa

SEQ ID NO: 3675 - DNA, 17517 bp, human
gctgcgtctttgcccactgaacagccatgagaaggcaactccggtccagaagggctccatcctttccttacagttatcgctacagactcgtgagtgccagagagcagaatattttgctgccccctccccttttattttaatggggtgggttgggggctgtgtagaccttggtttacggctgcctctctttgagacgggcagaaacagcgaagtttaggggagcccagggtttcaaaaaggagcagtgactcccagcacccccgggcaccctaaactgctggataaaaggaggaagcccctcttcctgtgaaacaaagataagggaaggagaagataacagagaataagtggcttctaaaatcttttcctgggagtatagaattttcacagaccttttggagtataaaagtttaattctaatagcaagaaatttagccaagagggaaggaaggaggaagaggaaatgaaaggcactgcctacccagctgtctcttgggtggtagcttcttagagtccagctgctctctttctaaagtagaaattccaaactatagctaaaatcatagaatccccaataggagcagggaggaatcctagacattatctctccagaacccctcattacctaaaggaggctgctgtggctcagagtacaggagtgacttgcaagttagtggaggagccaaagtgaaaatgcaatatcctcactgctaatcttgtactctttccattgtatttgcagaatgcatcttccaaacccccgatctgccactacccattgccatcctgactgccaccccacactgcccaacatgtagacacacatacattcttttgtctcatcatttatttccagggtgtattacaaattatttgatccaaaagtttatttgcatttattttgctataagtcattaatgtatgccacacgcagtgctttttggggagaggattttgaaatgttccccagagaggattgtgatctcagccccaggaggaaacaaagcctaagccatttttctttgggtatggccacttatgtaaccagggagttaagtgaagactgtcaacagcccgcagaagaaaacacacattattctaacctcctatcaatctacagagggcttctcttagctttttagccacaatttgaagaaccgtttaacttcccccaaagtttcttccagctctcaaaacagttacaatctgcaggggtataaaactatttcttacttgccttcttttctatgtaatcttgttaaaatgttgtgtataatttcagttatttgttaagtggcttggattttaaatgcatcaggggatcttgctctttataatacttgaccaaatttaaaaataaattaatgcaatcctgtgctaatttctcttttaaaattaaccagccattcaaatgtttatggtgtataaacacatgccttgctgtcttctttgcagagcacaaatttaaaatttatcctttgggtcatactgtttgtttatatatttgtttatatgtttatatatttagattactcaaaatggagctaccctctgttcttcagactcttccctttcagggaaacctgatgaccccatcacacacccactaccatatcccagcacactcacacacactatcacatgagggtagtgccactttaggaaagtgacaagacagaatcttagggataagcattctcattaccaaaggattttctattggattttgttaaatagtttcacaaagatacattttacacaggatttaattaatgaggatcttttggggaaggcctctcttgcacagtgtgaccatttcctttacctggaaacagaggagaggagaaaagattcgaggttcctaaagtaaagctcaggaacctctcacagcctctcgggtgtgagagctgtaggggcaaattagccgtgagaagattaattcttctcaggagggtaaagctttaatgacaagccatctgtaatgggattatcatgagagccaatatctacaaataagatcagtctgaggcctaggccagctgcctcctctgtggaaggttaaaggcaggcataggtaacatggagagaaaagaaaattgttcaggaaatataaagggaatatatatttctcctcaatgaaatgttatacttcaaattcactgagattctcaggtgcagtagattctctgggggccatgattgctacccactgtgatatacatgacagctcagtcagggtgacaagctctgtgagagcattcccgcagagtcctgcatcaggaattttaagtcaggcaggtatcactgatatttggttaggacccactgggtacttaactgtcagctttacactgtggagggccatcgagaggctagaaaatatggaatctccctctgggtgctcaaaatgtagtttgggagtttaaatgtgtgcataggttcacacacaagtgaaagatatttaagaacaggtattaatccattcatcattgagtgatgaagtttattttcctaagccttacactgtgagcctatgtcagtcagccatccttgattataataagcacctaaaatctttttttgtgtttttttgagacaatgtctcactctgtcacccaggctggagtacagtggcatgatcacagctcactgcagccttgacctcccaggctcaagtgatcctcctgcctcagcctcctgagtagctaggactacaggtgcatgccaccatgcctggttaatttttttttaattttgtagagacagggtctcactatgttgctcaggctgtcatcaaactcctgggttcaagtgatcctcctttcttggcctcccaaagtgtcgggattacaggcttgagccctaaaatcgtttaggaacacagaacctaaggcactgtgcttcattaatctactaagctacctctaggcacttgtgctcaatgtgatagaggagaaacatcattgtccagggtatcaagagacataggttccgagaccgtcaactctatcatgaatttactgcatggttttggctagatcctgtcccatctctgggcctcagatggataagtaaatcttgaaggtctctgtcggttctgatgtgatattttatatagagctgtacattggaacaaattagagagcaattcaagagggcttataatcaagagctagatagtgctgtgcagactgaatgctgagagctgagccttgtcattctgtatcacttgtactgattctgaacaatccaatttgctgagccctcctccccccaacaaaggcagcatttttagcagggtgccctctaaatggcctttgaggaatcaggccgggagggggcagcacagagcccctggtctctagtgtttgacacatccaacccaacaggtgcacagccccgcaactcttcagacttggacagcagagaagggagggcagcctcattttctgctgctgcaataagccttggcaaacccccaaagagcaaagatacaactctctggcctgtggctgggaggcatttgaaacaccacttggtgaagtctaggtttctctctccctctctctttttcagtttaattttcttagaaccactcagagaagattacagtttcaaatctcaagtaatggctgcaatcagtcaatcaacaaatatgtgctgagtatgtattacgtgcccagctttttgcctaagcatagggggagactaaggaagcccggggttccagctctcagatggtctttccaaccaatttaaggtaggaagagattcaaactagggcaataatcagagaagcagctaataactgcccatctattgtttctgttgggaaggaaggctaagttttgaggaggggtacagcagttggcctctcctcctgatgtccgtcccaggctatttttagacacaacttgaaatggtgaagttgagcagctgaatgtgtacagggtgttaggataaagctggcttggactgaaagtttgctatcacagacacaatgtctaagactattccatcctcttcctgtgtgagctcacctctactctgataggacaaggttaagtgggaggtcaaggccccagaacagagtagtgatatgagcagtccttggagaagagcccaaatgcctgaagctgagaataaaacttgcacctctatggaaagaatactgagtcaaaatgggtcatagaaaggatatttcctccaaaagaactagggagaaagaaaatccacctcttgtaacaacatgtatgtttatgggaaagtggaaatttgaagcatctccaaatattgagtcatttcgatttatttttggctggtgggatgcaccattgtacattttttttcaaaaagggtattgtgttttgtcactgttccaggatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagtaagtcccaatagtcccaatgccaaagtctggtgtcctttgcttttggtgtggtgttcagggctcctttaccatacgctggatgggcttgtctgcaaacttctctttgcacttcatgtaaaggcatcaatgcctagggaaatgcctagactgtggacagattccatcagaacaaactccaaatggatgaacaaacttgattgtgtaaccaaaacccactgggctcaacatcagttgcaatgcagagagacagtgagaatgagttgaaaaagcacatgatttttttaagtcccagtcctgtcactttctatccacgtgaccgtggactcatcatttcccctctctgagcctcagtttcctcacatgccaaatgaggaaaacaatccctgacttgcttctcttacaggatcagagtgaggccccaattagatgttaaaactgtaaagtttaaagaactatgcagaagacttcttgtaagaaatgagactcaaatccctgctaacatgaccaagtgtttttatgaggccccatcacctggtaatgtcagagaaggagagccaggaggcgtgtccctggccccagcttgtgggtgtcttcttctgctatgatagagatgtttgatcagtggcagaattatattccttagcatttcctctttgcatcacatgctgccattatttttactccacaacttcaccagcactcacctcctacagtcttacccacccttaaactattaatgctgagccttctcctcaggagatttagccagtggtaaaattcacacttgccacagtctctgcacagcccagaaaaagagcagctgctggtttggaaatcagtcaatccacagaagaaaaaaaatagaggatgccaaggatgaaataacagtcccctagtgccaagggtctaggttgctgaaattgatggccatgtcttctaaaggccccgttggctaagaattctctccctcaaagttaatgttgctaattcagctcagtcaaggtgacacactaagctctgtttcctggaattaggaatagcacgtgggatctcccttcacccctccccaattcccagccccacccctgaccatcccacaaactctcaactggaacaaatgtaccatttaaggaacattccgacattctggaagttgcagacaaatactggacactcacttggggctccaagggtgcacagctgtttctcccttgcctaaagaggactggaaaaacaagccttgtgaaatgcaagtgtgaatctgggagggggagcctaaacaaccagccattagatcttcaccagatgagctgatccaaattgcttctgtggaaggcaatccataggccaataagtggggatgagggaggaaggttcaagtgcccagagaagatatggcaatagggacacagcatgataggccgtagccagacctctgagtagcagatctaagtagagcccaggaattcatccactgggctaccctgggcaaagggtgaatggtaatgttaatgcttcagccataaagcacacgccttgctgtcttctttcctgagaacaaggtgcccgcttgtgcacttactaatgctgtcccaacctggacatcaacctgcccaatatatttaccaggcctatgaatataatctgggcctttcctttggtatctacgcaacccctattcttggaaactctatgttattttattggataccaacaagaatcatatgaggtagtaatattattatccccattttacagatgcagaaactgaggcttagagagggtaagtaacttgcctatagtcatatagttactaagtggcagtgctgggattacaaatcctggttggatgaacaccaaagttcattcttttgccagaacactgccccatttcatgaactctaacaatgaacaaggccctgatgtgtagggcctcaggacttgacacggtgttttagtgggagaaatgaagagttgggagcacggttacttagtggtctattcaagcccgggtggggcattgaggaaagaactctagagtacctagaggaaagacccaagtaatacttggacatccagggcagaaagtgtcagagggatcaatgggttcaaatggggactgtgcttggttttacctgggggtggctgagctagctatctcagtctgtgatcacctatcataaactctagggcgcccactcctgggtgaggctaaggggacttactgctagtgtcattctcccatctacagcttcctggtcacacatcctgggaaaaaaggaagatatctccaaaggaatgtacctatgttccattgctttcccttcatccatgaaactgagtcttttgatctccatggatggctctagctgttgatccattcctaggacagggatggggtaaaggaatggaggcagaaacacagggcaaatgccattagatagccagtgggcaacagccaagtatcacaggcacacaggtgctgtcgtttattctccagggactccaactgaatcaatgtgttcatgttccagttctgctttagttcatctaataaaataaaaagggtcagttccatttccagtcggattactatgggttttttttctcccttccacaacaccttttttggttaattttatttggttcatggttcaatttaaaaattaacatttggattcagtttggggtacagcaaagttaagtggtttgttccagtttctggttcataattcagttcaaatctgtaggtccaacatcatgtcatttctgtgagcagagccaaacattgttgcctgagagagccccaaggagggcttgaaaagagtttctcatcagcaatctcatactcattcacttcactcagtgttgcctaatcctgggacaaacctagtcctaatacagcccaaagagggaaaattcacacaacggtcctacagcactaataataatgttaataataactgatgatgactgccatttatggtgcaattagtatttgccaggctctgtgctatgctgcttatatgcattagtcaatgctaagaagtaagtaccactattgtacagacgaggaaattgaggcccagagaggtgaacagcatgtccaagattaatcagcttggaagtggtgtagtcaggataggacgttaaggaaagactgaatttcagatattgttagggatatagataagaatccgaggtaagtgctatttttatccccatcttacctgtgaggaattggaggtgcaaggaagttctgtaacttgccaaagttcacgggcaagtgtcagtgattaggtactgtctcctccttttcccttccccaccctgtgttagtgttctttttgaaaagcagagccattttattcatctttgctaaagatgaatacaatttgaaataagcaggccaaaacctcactttgccttgattggaggcaagtccagtggaaattcatcaaaagtttgaattatagactatgtggaaagaaatgctgttttcatcacttcaaatacctataattattggaaccaagctgctaggactcttcagggcacccactttaatgaatagcaaagaatgatttgtacttaggacatcaactgttgcccagaggactctcaagcaattttccctctgcaatacttttaactccactcccctgtattcttgttcatggccatcatttgctgagcaagcccttccatcggagatgctgtaaaggtaaactgcaattagacccctgacacaatcctcactgactccaaattggtgaaatctgaataagcaaggacatactgaatctgaggaattttttaaagagctatttcgtggttgggtttgttctggttcatgagtccaagcagggaggaagagcttgttggcaagcactgaccactctcatctgtgattgctctgcaggcctgatcttactcatttacttcttcttctatgcctccttggctgctgtgatcaccctctgcatgtacacactatttctgaccatcagtccctatataccaaccttcacggagcgggtaaagcctcctggtgagtgtgcccagatgccctgtgttgtcagaacttgctggacagaaatatgcttgcacagcatgttcagcctcaattaactttggctcttcctggtaatgacttagagattcaattattaggaggaaaagtaaaatggtacttggcaaattatggttcttttcattttgattgcctggggggaaatggtttcatgggaatcaatacaaaaaaattatcccaagaatgggttaatatatccaagacctgttttcattgccaggagttatgatcagacccttcgcccatagccttaacttcaacttcaacgtttctgaacccgacacttggcagcattatgtgattagcctaaatggctttctccagggtaagtaagttcgtctgaatagtggaaagctcttttgaaaggtgatgggtgggaatccaaaattcaaaattcacctggcccaggaatcccagtcttactaaccccaactcatcatggtctgtccttactttgcatcccccttagcacctgtagctacaatcagaattgctctagtgtgtgattgtatgttgtcttgaaaacatacaagccaattttccagcaagataagctctttgtggcagagaaattttttttcttgaacacgttacagtacccatttaagccctgaacatatccagatggctcaataatgatcatttatagaagataattcttgggggagatagtggtgggaaaagaagaatgttctccagagctgaaagattcctatcttctaaactttctcaaggtaaaagaagtcatttcttggagatgggttaacttgaagggagagggcaagcgtctttattttatttgagatggagtctcactctgtcgcccaggctggagtgcagtggtttgatctctgctctctgcaacctctgcctcccaagttcaagcgattatcctgcctcagcctcctgagtagctgggactacatgtgcgtgccaccacgccctgctaattttttgtattcttagtaaagatggggtttcaccgtgttagccaggatggtcttgatctcctgaccttgtgatccacgtgccttggcctcccaaagtgctgggatgacaggcatgagccaccgcgcccagccaagtgtcattatttaacagcattccagaaaggagttagaggaagaatctctgggtggcagtcgctccaacattctgatcccaagtattttcgaggtgcctatctctatagtgtcatcagataagttttcaggggcaaatgaatggctttgtgggagacgcttccacaaggtaaaatctgaggtagcagcttggttaaggttaacagagcacacaggttctttatgcagctatcaaagaggagctccagtggggtttgcatttctgcacctaatctttgtggggaaaaaaatgccagtcattctggcttggttgtcctggcctggttgaagtggggttgatccattctagaggcggctactattataacaagtgcactgaattaggaggagaacaatctcttatcatgtgctaggaggtgttatttaaatacataaatttggtcatttaactttaactctgcataataaagttgatcacgctcattttataaatgagaaaactgagactcagaaagggggagtagcttgatcaaagactctggcagcagaaccagtgtttgaatccacatttcttgttctttacactctcgctgctataagtgttataaagggaccaacaacatgggcatctcctgggagtttgttagaaaggcaaaatctcagaccacattctagacctgctgaatcaaaatctgcatttttaaaaaatccacaggtgatttgtaggaaatttaaagtttgagacatgctgcttttcataattctacgctgctgtcacatgaccaagagttagaaattcagctttatatcagtaaggctcagtgttattttgggtaagtctgagcttcagattccttaccagtgaaacgaggggagacgggactgggttctttctgagtccatgtagttctatttttagctacagaaatgttttgggcatcatggccagcacagtatcttcttttgtttcagaatgcttgcaagcgattgcaaatatattgccggattccctgctaagaaaatccctccaagaagctagtagacagagaaataccaattctgacctgatgatgatggaagcaggaaatgctaggaaaagcactagtttttagttcctaagagtagataatgtgtcctgctaaaaagaagcacatctctgaaatagacatcacagagtatcactttcactcccatgaggactgggattttgcaataagggtcatgtccatgtcacattatttttaatggaactacctcaagagaaacaatgagcacatgatcgcagcctctatttagaaagttatttgagcatagttcttgctctaaaaaaattaaaacaaagccttgaattaaatgtagctttgtcaaagaaaaaataaaggcatagccatatttggaatagatttaaaattcgcagttgccgattaataatatcaaacccaagtcacaacctgtgggtttgatattattagatgaggattcagcagcacattttgagttttacctctggtagatcacaggtgcaaaatctcctctgaaatactgagctactttgaacattaatacatagggactgagtctaacaggactaactgggctccatcatttagaatcaaattggaaataatgcagtaatttctaaagcccagttttatgtatgaaatttggtagcccaaagggttacctcacaaatagcccttttaagctttctccctgatatatgtatccttggacacatgttacattccatccaatgtaaaaggacatttatcctgaatgtctcaggcctcagttgacaagatctcatgccctcaccatccccgtagagaccctgtggttgtcattggtttctatcttttaacttatgcttctgttttgcagtgctaacttccctctgtaaaggatgaagagctggcttattccctcccccgcctcctcctcctgctccacctccttctcctcctcttcctcttcttccactttccttctgtctcacaactcatacttctcactcttacaatcaggtgcctctcactgacttcaaagggagacattgtaactgcccagcgggttcaccttgcccaccatctagacagagctgatttatcaagacaggggtattgcaatagagacagagtaatccacacccagccagctgtgcgggagactggatttttattattactcaaatcaatctccccaggactatttctctattgcaatcaaatccatgtacattgggtctgcagtgccccgccagtggagacagtaccagagtcggcctccagcccaagagaactaggtggctgcttgggctggcctctggatccattgccaggtcgggaggtggggtgctactgaaccacgagcaggtagccataagggcaatcccaaaagagcccccagatttgtaactgcccaatgggttcaccttgtttcctaagtgaagttaaggagatttaacccaggatataccatatatatacccttatatataccaggatatacccttatatataccaggatatataaggatatacccttatatataccatatacccttatatataatatatatatacccttatatataatatatatatacccttatatataatatatatatacccttatatataatatatatatacccttatatataatataatattatattatatatatataatataatatataatatatatattatatacccttatatataatatatatatatacccttatatataatatatatattatattatatataagggtgtatatatatatattatatatatataatatatatatattatatacccttatatatattatattatatataagggtatatatatattatatataagggtatatatatattatatataagggtatatataagggtatatccttatatatcctggtatatatatatacccttatatatacccttatataccataccttgaatgtttcagtccctcttccaaaatctaccaactatgtgcctatttctctctcagaagtagaagggacagccttccaagtttacagtttatcatgtctgaaaagaaatggtggaaaatagagaaaatttataaagtgactgacataggacccagagatggatatccagaagttccatgggaatgaaaagcaaaggaacaggcaatcaaactgggctgaagtgactagtcaggaagacttcctagagggatggctgccgatgaaggctgttgggcacctgatgccaggtcacaggtagactgagtgggctttcagaggagtacaaacaagctggagaaaggaaacttgggagggaggactactgaacgcacggccttcccctgtagcacctgtctaacataacctgttgccactcacacatgctttaggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccgggtatattggcttttcatatctggtggtgataagcgaatgaactagataggagggctctggccactccatttgtcttggtctctgtcttcacacaccacaggtttggccatttttctgacagtatcataaatacaaataaccagataaacctatcaatttcttcccccccgcccaccgagcacttcctatggccattcttctccctcacccccaaacctgtcacttgatggcctttgtcaagaatggggtcctagtcaagtgcagtggctcgaggttataatccaagctactcgggaggctgaggaaggagggttgcttgagcttaggagttcaagtttaacttgggcaacatagtgagacttcatctttaattttttaaaaaagtattttaaataaagaatggaatactgagctgtttggaacaggggattgaaatgagggtggcatgggggacagttcttatatcataaaaatgcatttttcttccatcctgtcatgacttaggtgtggcagagccttatcagtcacacctctcttgaaattagaaagttctttacatctttagcattgacttgctgacgtttccccttgtgtgtaaataccaggcataaatacaacacggagtaagctgagctgcttagctctgaagatgtttttcattttttgctttttgtaacatttctgagaaggcgaaatagatgaagcatatgcctgaggaagcatgactgggaggaaggttagaaaagcccaattttttactgtcaaatatgttttgttaaaaaaaaataaaacactggttttcttttgatagattgtaggctttcgtcctgagcttggagatcctgtgaaggtttcctgcaaagttcaggtaaagagtccttttgagtaagcattgttagcacatctgtttcatgcaaaaaggtagtccatcactttcaaggacttacacatggatggtaggctaaggaaaaggttaatcttttcataactacacctctctttagttccttcaggttttcctctttccagaaagcattcaattcatgtgtgtttgtgtgtatagtgtatgtgtgtgtatgtgtgtgtgtcagtcagtctgtcatgattaatacttctgaaaaccaaagactgaacttcagctaagggccacagcagggaacaacaatgtgccaagtcattaattgagattctgtttacacttttgcttttagctctaattacttgtttctttgaactaaacaaacagctttcattagagtcattagttcccagattttaaaactgaatttcacattttgcagcaatgaccagtggtactgggtgttgcaataacaaatgactacatgggaagtataaacagaactcgattaatatgctaattaactgtccttcgagggaccattaacttctatctcatctgcaccaattagctcccttgtaggaaaaagcccttagatcttgggtttgcttcttaaacaggcagtagctttctcctgttctatgacatcaactgcacccccagacctggatagttgtcttgcaaatgcgtgaggcctggtaatcccattctcagtaggagaaatacagttgaaaacttcagtcttcatggtgacagatcagaaaacagcaaaaggcagcagttattcagccaatatcccacatttagcaagcatttattgatcacttattatatagcagatcctctgctaggtgttagaagtgtcgaggtaagagtatgactccgtctctgaaatcaagacaatcaagtattacatgtgctgtgaaaagtgaagatgagctctgaaaggtcaggcagtacttgccaaatgaacaaggtaggaagcacattctgttctcatgtatatgtgtaaatattcacaacatgaggtgacactacaaactatccgaactgattcctcaggccttcatgaaaaataaatttcattgctttttagaagaatgtattaaaagtaaatcataaagaccaacttagtcttaagttagcatattaactggacagagttctacttattgttccctaatggaagctgtttgtttttcagcttacatcaaaccttgctaagaactgtcctttctaaaattgttttaatgttttaattattatttttagctacctccttacatattttatgtccttttaaaaaatatattaagaatctctatacattctataataaacaatactggtcaaatccacacccatttgtgaaaatcaagcaggatgaggtaatgactagaataaattaaggagagcttagtttgtaccaagaacaattatagtatattgacagaagtaatcacatgaccttagtgagtaatttgctagtagtgatgcactatttgtccttactagcccccagacctctgctatttagggcaagccgaatgtatcacagaatgggcagcccctacctgacataatgtgatgagtgtagatctgtttactttaatcatttccatacccaggctcttgttgcttacccctctgaccccacctactgtaattaagcactacagagaatatggtcagagacatgagtctaggtgagccaactgtaggctgtgtgcctgtgtatcaggtacctatgcacttgatctgacttccaatagaaccgagcctgcagtgtgcaaatcgtggagtgggatttactaaatatgttctaacgtatatcttcctcagctccaaagtccaagactgggtgccaggcccagtgtggttctttggagaaaggctggagttgtaggtcctctttccagagcagcatcaggtactgcaagccctttggattgcttctgtctgggtaccccagaagccaacagagagccatactgagcacctttgtcctcctcagttcaggccttctactcaatattctttgaactgaaaagacaaggcacagtcactccctaaaaatgctcatctagggacaggtcacggctgagctctgctccattctgctttcatggtcttcctggaacagttggttatggttcacacagtgatttcacctgggtacaactccctttagctcagactctagcccactctgtgacccagcaccccacatatacctgcttttgcttacagagaggtgatgaaaatgacatccgatccatcagttactacccagagtcggcttcttttgacctccgctactacccttactacggcaaactgactcacgtaagctgtattccctttagtcattgctgtcagaaagggctcagtgacaaaagaagagctggctgggatctatgagaattagggagcaggagatagtagaggggtaaatagctgctggccataaccaggagctccctttaccaattcttatcacaaccacactcctttccatatctgaaagaatctcatatatggcctaatttaaccttttaagtttacgaatgggaaaattggggttcagagacagaaagtgacttgcccaagaccatacagctaagttagtggcagggtcaggagcagataaattactaccaatgtgcttaaacatgccctaataatcacgcttctgtttctcccatttgaagcgctggggtgagtccccaacacagggactcgatagacactagttttggtttaattcatggtctgatttccagaaaaatcatatcatgctgaatcagaattggtttttcccagaggacaatcagatatctgacagtgacttgttagagaaatgtatgattttcccacactttcccactgcaaggagagtatgtctgttgctttggccatttgcaaattggcatcatgggatttactcagttctctttgtgagggttgtcatcctgcagtgattatctgatcacttccctcctaccacctccccacacttagaattcatttttcttctacctgcaggttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttacca

SEQ ID NO: 3676 - DNA, 20259 bp, human; identical to SEQ ID NO: 3674

SEQ ID NO: 3677 - DNA, 20259 bp, human; identical to SEQ ID NO: 3674

SEQ ID NO: 3678 - DNA, 20259 bp, human; identical to SEQ ID NO: 3674

SEQ ID NO: 3679 - DNA, 302 bp, human
tcaaggggacggcggagcaaccccagtgcggcttcagcaacgccatggtgcagatcctgtgggtgcacggcgtccgcgactatgcggcctacgaagtgctggacgaccccgagctgcgacaaggcattaaagactattccaactggcccaccatcccgcaagtgtacctcaacggcgagtttgtgcggggctgtgacattcttttgcagatgcaccagaatgggggtctggtggaagaactgaaaaagctggggatccactccgcccttttagatgaaaagaaagaccaagactcaaagtga

SEQ ID NO: 3680 - DNA, 69141 bp, human
aaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaa

SEQ ID NO: 3681 - DNA, 20382 bp, human
gagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 3682 - DNA, 20528 bp, human
gctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 3683 - DNA, 20046 bp, human
gcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaa

SEQ ID NO: 3684 - DNA, 233177 bp, human
gcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcag

SEQ ID NO: 3685 - DNA, 298561 bp, human
gacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggg

SEQ ID NO: 3686 - DNA, 306660 bp, human
gagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgt

SEQ ID NO: 3687 - DNA, 306430 bp, human
gacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaa

SEQ ID NO: 3688 - DNA, 304363 bp, human
gcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgtgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactccattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctcttatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacatcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtaagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaacttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaagtcctggggcagaaacaatcctggaatgtttaaaggaaggaagaaaaccactgtggctgaagaatagtagcctacattagaattatagtgatggagactgtgtgaaggaatcagatttatgattcattttggaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttaaacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatctcatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttaaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctgtgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcttacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaactcttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacataaggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttttaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggatctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctatgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccgttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtatgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaactgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaaaaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcccctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcaacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaaaaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgacttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagattttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtg

SEQ ID NO: 3689 - DNA, 233177 bp, human; identical to SEQ ID NO: 3684

SEQ ID NO: 3690 - DNA, 298561 bp, human; identical to SEQ ID NO: 3685

SEQ ID NO: 3691 - DNA, 306660 bp, human; identical to SEQ ID NO: 3686

SEQ ID NO: 3692 - DNA, 306430 bp, human; identical to SEQ ID NO: 3687

SEQ ID NO: 3693 - DNA, 304363 bp, human; identical to SEQ ID NO: 3688

SEQ ID NO: 3694 - DNA, 461969 bp, human
tagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggtaagttataaaatggcggaggcgaagcttctagaagtttggaggggcacccggagggcgcttggcccaccgtgaggtgtgtatgattgaaacagggcgagagagaggagttgggagggaaagaggttgggcactctgttgccattgaatttcccctctgctttcttcgcccccatggggggcagccatggaacggggggcagagtccaggcgggaggatctttctcgcccccgcggcgccccccgccctcctttctcccttctccccccaagtcgctaccccaacacttccaaggaacttccagccccccttcctccctacctcctactcctagagtggctttctaccgcagggctcttcttttcgactaccctcgctgaagattttctcttccttccctcgcccaactctccctcggggcctctacggagaccccccccccccatgggtggcccaaaatggagaacgcggagcagcgcaagatggaggctccgcttctctgtgtagcagtagatttaggttccttttctccggcaggctcctaagcctaggagagcccgaactggaggtggggtggggtgcgagccgtagtcgggggaggaaagccgggaggctgtggttggggtgggggagagcgcggtgtcgcggtgaggggaaggcagagagcaaaatggtggtgctgggaacctaggggggaggggagaaaggaggctcagttgtgtatatttgggcctcggaccgagggaggcgagggaaaatctactctgatcacacccctccctcgtgccccctcccttctcccttcccctcctcccttccctccctcccccctccctccctctcttcctcccttcctagagagggaacaacattcatgtgacgggcccctctgcttctcccccgccccatcatctccagcgcgtggtgggggaactgctggggaaggcgattggcatcgatctctccatcccttccgaggcccgacttcggtcagttttcttcgggcaacaattttctaaattggctggggtctggcggtgttggcccccgcgcgcagaccttgccccgaagggggccctgcctgcctggcatgggcggaggggggaagggcgggagtggaaggctgtttgttggggggttttggcgccacttttgttttagttttagtgctgcttttcattcccacccccacccgcactgtctttctcaaggcacgaactgagctgatccttgccccaggtaggcagcctgtgcgttttcactccacacttttattcttgctcggggtcgactttcttttttcttctcccctggatccggagatctgcggacggcgattttgggacgaaaagggtcggatgggccgtgggagagagaaggtgtgggaaacagcatcaagtagttccgcaaaactttgagccccgttcccattttcttttggcctagaattgtgaacgtattgttgatttcggcctttttttccccccgtcgcgagaatgtcttgttttgcctttagttttttataaaccgctgtactttcgacatttagtttccgctcccccttggtgcatatgtcattttatttttaatccttaactgtaatgggttatcgtgtgattttcgtgcttcagtgctcggctttaatttttaatattgtattagtagtttcatccggtttgtgagactttctcttccgtggcctagaatgttttttatgttgttgcctaccacccctcttccctctccctccttctttctcttggatgtagtttttaaattgagggccatggtgttggattaaatggtaatttacagtttacatgatatatctattggaaacttttgatctgtaaggttagatttaaagtaaacgaggcgcttgtgttggtttgcaatggttccttaaaatgcgcgggccacccccttctcccaccataaagccccatcttcccttcacactggagtgtaaattccataccccttttctcccacggaccgccgtatttcgcagcagccacaccctgtatttgtctctgtggattggactcattatcagcttaatttagtgactcttaaaccaccatgatgggacttgcttaagcacgaagcttcttttcctgtttagtcctagtggttagtgtcgaaagaggaatcatcgaggtttcttgatgaaacctagtgcggtccaacctctgcctttttttctgttgtcttttttcctactccgggctgttggcggtgtcagcaccgctgctgggggcgggggtggaggggagaaagagtcgggttaccgaagtgcgtcattcctggctctagcagggcctgctcgggagctgctggtgtttgttactgtcctcgcagcacttttctgccaaccttctctctctgcgtattggttaggagcaaaagcaggaggcggtctcctaattctgtctgtagcctagcgcgttgcgtttaagggtatatctgaacttattttgttaaaaaaaaggctctgggaagtggatgcatttgtttaatgacatataattcaggtagtttaggcttgctctcatatactttccgatgaacagtggggttaattttcaacattttcaaccacttaacgttaaaatgcctggttttctttctacattgatatcaatctataattagggatcagaaggaccagtttaaggtatataagtgttcagcagtttttcaagtggttgaattgcagttttatgacacattatgttaaatagtcgatttttttttttcattttgaactaaggtgccacgttaagtaagttaattgcagatgtttaagttcgttttcatcacatttccctatttgtctttttaggtataattttaaatatgccctttgggtttatggacttcattaaaattcttaaagatggttatatctttgtgtttaactgaattcttaaatttatcacctaccaaagaattgtgtaaggcgtaaggcggctgtatagttacattgttggattttgacttaacatgctagtttttgatacttttgctatctttgggtagaagtgtacttagagaacatagtatcttcctcttaattctttttgaagataataatgagaggagggagtgggtaggaggtaggtgtgaagcagaagtggccttgagttgattattgtagctggatgaatacagaagcgctcattgttactattattctctctacttttgtgcgtgctgttaaacatttccatagtttaagataaactttttttgcagtagaatttccagattgtcttacagtcttgggggtaatgacttaagtttatatttacatgtcaaaattacttgcataggaaatttagccttgtgtaagtgattacacaatgcttggcaaaactttcaaaaaaaaaaaaacgtttaaacgggaactagtataaaacaggcaacataaatacttataaattggttgaactttaaatgtttataacttagcctgaatgtgctctacttttagtttcctttttaattctttgaaaacaggaaaattccatttgcaatttttgtaaattctgcttagtgtctatttcatcaagttggagttacagtgagtcagtatgaaagggatttactattaataggaggggctttggcagttgcagtaagtgacagtggaagggattgaggtaccatagggagcattcctggtagaaagatctaggtagctgaattcagtttcagaatttggtgtttaatgactaggtagagaagtgggttggaaaagaaatgtacttattagctattccttcccactgtgaagtaactatagtattctaaggtgtatcagagactggcagagagggtggagtgggtttttttttttttaactgataagaaaatgagtgtttacatttaaaatggtttaaatcacctcatgccccaaggatctggtgctataactagttagaagttgatatgtaaaatatttcaatattgtctgttaacattctgaccattacccgtaaacagtaaaaatgtgttgcaatgacaatccttggtctcccttaattagtgcatttgtgaactgctcctaaattctattaaggtaagtgccttttttttttttttttttggcagttctatactgttcagtgtcaggtttatttttttcccccaggagatacattttaaaaatacatgtcacagttccgaaaggaatccaaaacaatggatatttaatttatagcaaaatttcaccccaatctgggaacagacattttgtaactgttaccattagtctgtttgtgtatttcatattcaggattttagctttagaaggatgttaaaggaaaataggtgacatatttcaaatttttattcatatacaaatattcttagtagatggtaaggattgtggcatcagatttattttattgtggtgaggcaatagctaaactactacactaacacatgatgagtttggtaactttcaagtatatttagttaggattttttaaagcccaaatgctcaaataagattttcatgaaatcaaattctacatttctttttcaactgtattgacttctgcggtcacctgaggacttatgaattaaagtgaatgggatgggcttgggggacaggctaaggctcagatctattcctttgggaatttagggttagatgtgaaaatatgcagtttagtaatgcttaatattgtgcatgtttaactgataccacccacagtcatatgtgggaaggtagtaaacagagaatagcataatctttctgcttcgggttctttataatagatggcagacttcagtttttgatgctgcaagttgacttttgaacttaaaccaaaatcggcggggcacagtggctcacacctgtaataccaacactttgggaggctgagaggctgaagtggggggatcacttgagcccaaggagttcaagaccagcctgggcaacatagggagaccccatgtttatagataatttaaaaattaggtgtggtggtgcacacctgtggtcccagctatttgggaggctgaggcaggaggatcacctgagcccggtacatagaggctgcagtaagccacgattgcgccactgcacccagcctgggcaacagagcaagaccctgtctcaaaaaaaaattaaaaataaactaaaatgtacagtttactatataatggagtaccgttttgggagttggggagaatagcgagggagagggatagtttcaggtatgggcatcagtatatactgaagtgtgattgttggagagtaaggaaggaactttaaagacataggctattttaaaagtttttggctgggcaccatggctcacgcctgtaatcctagcactttggaaggctgaggcaggcggatcatgaggtcaggagttcaagaccagcctggccaacatggtgaaacccccatctctactaaaaatactaaaattagctggacgtggtggtgcgcgtctgtagtcccagctgcttgggaggctgaggcaggagaatcgcttgaacctgggaggcagaggttgcagtgagctgagatcgcgccactgcactgtagcctgggcgacagcgagactccgtttaaaaaaaaaaaaagttcttaacatttttctgcattggctacatgttcaggactttagttcgtgtttcagtactgtccctgtgtaataattctttatgtttctgggtatcataaatgatggttattgcgtgttctgattggcaaagatatatgataaagcaaaattatcagtttgatttttcagtctcttgagttgactgctttacgtttaatttacccaaattttatatttcttcagtgtaagtggtgttgcttagtggagtctaatttttgttgatgtgccttttaaaaatctatgcatcttcagcagctgtggtaatctgctacctgaattgtgtttttaatgtgtgcttgctatagatctttgatactcaccagtagacaccaagaagtctttacatatggttattgtagtaagtcaagaagagatttatttattttttgagacggagttttgctcttgttgcccaggctggagtgcagtggcatgatcttgggctccctgcaacctttgcctcccgggttcaagtgattctcctgcctcaacctcccagtagctgggattacaggtgtccgctaccacgcccagctaattttttgtgtttttagtagagacagagtttcaccatgttggtcagggtggtctcaaactcctgacctcaggtgatccacccaccacagcctcccaaagtgctgggattacaggcggagccaccgtgcctggccaagaagagattattgaaattgttttccattccttctgccgaagaaagagaggatgaataatgtcaatggtgtattttttttttttttttttttttttttgagacggagttttgctcttgttgcccaggctagagtgcaatggtgcgatcttggctcactgcaacctccacctactgggttcaagcgattctcctgcctcggcctcccgagtagctgggattacaggcatgtgccaccacaccgggctaattttgtacttttagtagagacggggttttttccatgttggtcaggctggtctcgaactcccgacctcaggtgatctgcctgcctcggccttccaaagttctgggattacaggcgtgagccactgcgcccagctggcctattcttttttattacagtcatgcattgcttaacggcgggcataccttctgagaaatgcatctttaggtgattttgttgtgtgagcatcatacagtgtacctacacacacctagatggaatagcctactatacatctatgccatatggtatgacctgttgctcctaggctacaatcctgtacagcatgttgctgtactgaatatcgtaggcagttataatacagtggtaagtatttgtgtttgaaaacaaaaaagatacaataaaaatacggtataaaagaaaaaatagtacacctctatagggcagctcccttataatcttatgggaccactgtcttttttttttttttagatggagtctccctctgtcgctcaggctggggtgcagtggcgagatcttggctcactgcaacctctgcctcctgagttcaagcgattctcctgccttagcctctcaagtagctgggattacagatgcatgccaccatacccggctaatctttgtatttttggtagagacgggctttcaccatattggtcaggctggtctcaaacgcctgacctcgtgatccgcctgcctcagcctccccaagtgctgggattacaggcatgagccactacacccagctgggaccaccgtcttatatgcagtctgttgtggactaaaatgtcattatatggcacatgactgtattttaattgggaaatacattactaggcttgatgagacaaactagggagatttcagtaagctctgcctaacttaagggaccattcaaaggtaaaatttctttgtaagaaataagttggctgggcgtggtgactcaccctctgaatcccagcactttggtaggccaaggtgggaagatctgttgagcccaggagtttgagaccatcctgggcaacgtagggagaccccatctctacaaaaaaatttaacaattagctgggtatggttgtgcagcctgtggccccagttactggggaggctgaggtgggaggatcacttgagccccagcaggttgagcctgcagtgagccatgatcatgcctttgcacttcagcctgggcaaaagagtaagaccctatctcaaaaagttgtttaaattctgttgtacatcgttcaaggggggtgaaaaacaagtcctatttacatttttgcaagaataacttttgaaacctgaagcattctaagaaacttaatttaactgctatttaagttcctactgaatgccagtaatgctttaatcttctgtttaatcttctcaaccactttgcaggataggttgtcctcatcattttacacgtggggaaattgacgctctcagagagtaaatgccttgtctcaagtcacatggattcacactcagattagcctggcctcaaaacctttgtgcttttttgttaaactcagttgtttcccttatctggtttaggtcttgggctatctgtcatcagagagcatgcattcttattttaattttacaaaatcaagattctttttcatgtatagtgcaaggtaaatatagatttttacccagagtcagataagttgctgcctgaggtctatattgtcttttaatagtaatagaagtagttgaaataaatctgagcattggttttgtttgcatatgcttattaaagtttgtgggataatgaattgtattcttgaattttttggggggggaatcatgtgatacatgaaatggtttcatagatattttttcttttaggtcatttatgctctatttaaaatggagattacatgtgtctgagaattgttccccagtccttcagcttgttttactgagtggttagattcgaagtaaaaagtttaggctaatctttaataattcagcgctctggttctttaggggtattttttgttatttaattgtaccttaaaaattcttttttattctgttaatatctcctgtttgcttatacttcctattttagttcatctttcactattaagttttcttgttcttactgttatcaggtgataaatagttaatatcagggccccaagttattaggttcattagtgatcggtatcttagtctcagttttctttttcctttctgttttttttttagatggagtttcgcgcttgttgcccaggctgtggtgcagtggcatgattggctcactgcaacctccgcctcccaggttcaagcgatttcctcgcctcagcctcccgagtagctgggactacaggcgcgtaccaccacacccggctaattttttgtatttttggtagagacgggatttccccatgttggccaggctggtctcgaactcctgacctcaggtgattcacccatctccaccccacaaagtgctgggattacaggcgtgagccaccgcacccggtcttcctgtttttttttttttttttttttttttttaattgtaactgaagttttttttatctgaaggaattctggttgttggacttatgacctaagataaatttatggagacaaggaaaacaaaatatatatatttgtgcttttcatagccatgagtcaaatttatatgtttatattgatcattcctttaagctttaacatgtaggaaatacttttttcccaggtgatgaacagcagtcttatactcagactctttgttcattgaggagtcttttcatccatatttccccctttgtattccaagaaaaccaagaactggtgttccatgacagaattattccccgaggcatccattgtatattataaattagtttctcccctgcacatctagaaagatattagttaggtatcattcttgggagacttcaggaatagtcactgaagtcattttctgagttctgtagtcaagtcattttctgagttctgtagttaacatgaggaacactggttgagaaaggctgctagaatattaagggacttggtttggcactaaataaagttttacttttcactgtcactttcctgttagtaactctaatatggcctctattaaaattcgtgatacaatgtgaatgctgttgatactgctattgctgtgggataaattggttagtgttgatttcaagcagttagtgctgcttagttgtttgaaagaatttaatgtgggacattaaatgcatcattttatttataagaaggaatattgtgggagcactgttcattatacagttcaaaatctataaaaagtcactgacagtgactaacatgaacaagaactaatactaactgaactcttaccatatgccagatactcttaaaaatgctttgtgtgtattagcttactttatcttagtaactctatgaggtaggatgaccatatgatttattgttcaagccaggatacttttgaacgtgaaagggattgcttcttggccttttggctaagatcaagggaagagtgagtgaaagggggcactcactgaatggcatgctgagataatagcagaaactaggactgtttgagagaaaggatgtgtgatgaccctaattaataccttctttttcagaagaaactgaagcatagggagaccaaataacttgcccacttagtaagcggtaagaagggatttaaaacctctgtagaggctgggcgcggtggctcatgcctgtaatcccagcactttgggaggccgaggcaggtggaccacctgaggtcaggagttcgagccagcctggccaatatggtgaaaccccgtctctactaaaaatataaaaattagccaggtgtggtggcatgtgcctgtaatcccagcttcttgggaggctgaggtaggagaattgcctgaagctgggggtagaggttacagtgagctgagattgcgtcactgcactccagcctgggcaacagagcaagactcttgtctctaaaataaaataaaacctgtagagatttctatgggaatgaaagtgatttaaattattttaaattgccatattctgggagtttgtttacttttacccttttgggggagtttttgttggtacatggtcaatagtaaaaagacaagatagtgttttttaaaatccaggagaatttccacttggatttttttcaagtggctgttagactgaggtgattatattgtcttaatgttgaaaagcaactttcctgagggccacctaagttaaaacaaaactctaagataacgacatctgagtttgttttccgtatgtattattcaggttccctttaccattttcttaggcagaaatgtggattgtagaaatttttactgagaagacagtagaaagaagatgaatacttttgtgactagggagaagtgttactagaaaagaaagaaaaaggtccagtttagagacttttgaaggtaaactgattctgtagcatagtttgagagttaagtcttgtagagattaatatgtcatttcataaaaaatatccctcttttattgtgatttttaaagctattttatatttctggcctgtttatgcttgtgctgtcacctgaaaaaatattactggtgaattcaaatgtggagaaatgattttggcacagttgtggaaacaactatattgtaaactaagatctttttttttcctttgagtgggagtgaatggtagtatctgatcttaaggagacttccagttttgttttcatacttggctattttaatagttcattgagtaatttgtgtttttttttttccctctagctagttgacgtttggaggttttgttggtgtaactatcattttttttttttctttttttttgaggtggagtcgcccaggctggagtgcagtggcgcaatctcagctcactgcaagctccacctccggggttcacgccattctcctgcctcagcctcccgagtagctgggactacaggcgcctgccaccatggccggctaatttttttgtatttttagtagagacggggtttcaccgtgttagccaggatggtcttgatctcctgacctcgtgatccgcccgcctcggcctcccaaagtgccgggattacaggcgtgagccaccgcgcccggccaatttttaaggtcttttatttagttcattgaaaccattatgagacaagatatagcttgaagggggactgcatttctcaccagatgaaggaatttgtggcctgtgtagtgactacgggagacaaaaggttattttgaggagatttgatttattatataagattaatgggctgggctaggtggctcatgcctgtattcccagcactttgggaggctgaggctggtggatcacttgagctcaggagttcaagaccagtctgggcaacatggtgaaactccccccctctaccaaaaatacaaaaaaaaaaaaaaaaaaaaaaaaagaaccgaatcagcctggcgtggtggcgctcacctgtggtctcagctactcaggaggcagaggtgggaggatcacttgagcctgggaggcggaggttgcagtgagctgagattgtgacattgtactccagcctgggtgatagagtgagacccccactcaaaagagaaaaaaaacagtagtaaaataaaataaaaaaaaaatgcagttggattttaaatactatattgctggtttttaagctggggtccatgaatgggatggagatttgtgaaccctctcaaattatgtacaaactgtatacatgcatttcatcagtttctctagggctcattgttaaaatcagctggtatttaaagtacttatgggggaccgggtgcggtagctcatcatgcctgtaatcccagcactttgggaggctgaggcaggcagatcatgaggtcaggagatcgagaccatcctggccaacacggtgagaccccgtctctactaaaataacaaaaaattagccgggcatggtggcgcgtgcctgtagtcccagctactcgggtggctgaggcaggggaattgcttgaacccgggaggctgagattgcagtgagccgagatcgtgccacagcactccagcctggcaacagagtgagactctgtctcaaaaaaaaaaaaaaaaaaaatagactgggcgcggtggctcacacctgtaatcccagcactttgggaggctgaggtgggcagatcacctgaggtcaggaattcaagactagcctgagcaatgtggagaaaccccatctctactaaaaatgcaaaattagctgggtgtggtggtgcatgcctgtagtcccagctattcgggaggctgaggcaggagaattgcttgaacctgggaggtggaggttgcagtgagctgagatcacgccattgcactccagcctggacaacaagagtgaaactccctctcaaaaaaaaaaaaaagtacctatgaaagatgggatatacaatggtaaactagattacatagtctctgcccttaggggaatatagtcagttggactttgtcactacagaagggttaaaaaaatacctattaaaataccgtgtattgggtttacattaaagaatattgggctaaaaccagccatcaatgcagttttggcactgtgttcctaatgtgagattagtgacatactgaaaaattagggctgcactgaaaaacttcagggaaaaataacaactgagaaaacaagcagaacaaccgagggctttaatgtagccttggaatgcttcagtctttggcagttgttaataaacaaagttaaaagagcccatgatcatcttttcttttcttttttcttttttttttttttgagacggagccttactctgttggccaggctggagtgtagtggcacaatcttggcttactgaaacctccacctcctgagttcaagtgattctcctgccttagcctcccaagtagttgggattacaggcacccgccaccaggcctggctaatttttgtatagagaaagggtttcactgtgttggccaggcttgtatcgaactcctgagctcaagtgataacacccgtcttggcctcccaaagtgctgggattacaggcatgagctaccgtgcctggccccatgatcatcttatatatgcagttactgttatccaaaggttgataccttctttttttttttttttttttgagatggagtctcgctctgtcgcccagactggagtgcagtggcgtgatctcggctcactgcaacctctgcctcctgggttcaggcgattctcctgcttcagcctcttgagtagctgggattacaggtgcatgccaccacgcctggctaatttttgtatttttagtacagatggggtttcaccatatttgtgaggctggtctcgaactcctgatgtagtgatccgcccgccttggcctcccaaagtgctgggattacaggcatgagccaccacacccggcctagtatttgattttcattacattcactcacccacacactcatcatataaaatgattgaggtttggtatacttgaagtattttcatttcaggattgggatatatgataacctctttccttagatttccaatctttttttcctttcaaaagcaagggtaatttttacagtcaccagtgtgtctactgccttgtacctaatttgcaaactttatggtggctagaatgttattacaaagaacatgtttgatatcttcttactaaaatagaggcattttttgtagtctaaagaaatagtatatatataaagataggaaaatgaacctttgagaatttcccttctacactattaaaaagaagaagataaaatgtaggaaatattattagcaaaaccataatatttttcctttgggatatgtccctccctgtttccaccactcattcagtccaaaagacattcctcagactttactcctggcaggagaattgaggaagtggtggtagtcatggttggcagagaagcagaagcatgaaggtatgtttttgaaaagcaaacttgtcaatgacaaatggatttttccagttgtgagtatacgtacttttttttgagccagagtttcgctcttgttgcccaggctggagtgcaatggcgtgatctcagctcaccggcaacctccgcctcctgggttcaagcgattctcctgcctcagcctcctgattagctgggattacaggcatgtgccaccatgtccggctaattttgtacttttagtagagatgggggtttctccatgttggtcaggctggtctcgaactcccaacctcaggtgatccgcccaccttggcctcccaaagtgctgggattacaggcatgagccaccatgccctgcggaatatgtactttttgagttttgattaaatatcagtgcataaagtgctactgttcattgaggaatatttagtagttatattcatatttgggtattctgaatatacttgaaaaatttcagaaggatcatttggacaatatgggattttattagaaaagttcctatagtaggacatttgttcctaatccttttaagttagactgaagcagttttctaagttactatggaaaaataggtttctgccgggagcagtggctcacacctataatcccaacactttgggaggcagaggtaggagcccaggagttccagaccggcctgggcaacagagcgagaccctgtctctaccaaaaattcaaaaattagccaggcatggcagtgtacatctgtaatctcagcaacttgggaggctgagatgggaggattacttgagcccaggaggttgaggctgcagtgagccaaggtcgtgccactgcactccaacctgggtgacagtagtgaccttttctcttaaaaaaaaatttaaaaagatgaaattaaattttaaaaaagaaagatttgtaactggaggcaattgtgtgtgcatatatgtataaatatatagtatttgaatgtacaatattggcaaatatccagatttatctcatagcaagattaaccttttcagtctaggaactgttttcatctgattttgaatccttgtttcattgtgcagtatatattatacaggttctcaaatggtaattgaattgaaaccttcgtttttttttaaagaaatgtaaacctgcattataattgcattattggtattcatatttaaaagctgcatattggaagaaaaatagtttcccatagttggttttacattaatgataaagtttgtatcgacaggataccacttacagcatcttcttactatatgacaagttgtactaggctccctaacatttaattttttgtttctcacaacaaccctattgaggttgtttactgaggttcagaattgttagagacttgcccaagatcacttagctaataagtggccaagcttactttttgaatccaattctgcctaattccagaacactcctttacatggtgatacactgcctcccagtgggatgatttatagatttcatagtgatactttctttggggaaagagaatataaaggatacaagaactctaaatggaaaagacagaggaggaagttaaacttctcatagtggtcaggaaccttttgggggattaagtaggaggaaagcttattttcagctgagagctgatggatgtttgaagttgcatgtgatatgtgtcatgttttataataaacatcaagtagcaactagaaaaggcttagcggcagggagatgataaagtttcttacactgtagtgatgataaagtttcttacactgtactgatgataaagtttcttatactgtactgttttaatcttgagtaaagtgacatctgaattaattttaaggaattaacctttatagaaaataaactgaaacaaaatgttaatctaaagcattgtctccataggtagtgttcccaccaaagaacaataattctaataagaataatctgttcaggtaaactggtctaagtcaggcagcattatgattccagtttgtgttttggttttcatattccactagcctcccttttctgctgttttttttccccccctccggtatctttacagtttctgtagttcttcataaaaagtagaaatgttttgatggcgatttccttattttacttttatgctgttactgctaacagtagacagccttatttgtgaggcactgaaatagaagtgatttcaaaaattaatccatttcgtgactcagaaacatttcctttaaaaataatgaaaaaaaatagaaaaattagtccatttaaatttccctacaagcctgtgaggtgttgatgctattattattttctgtttgtgtgtgaggaaacggaggcatagtgagcttaaactttttctaagcacacacatacttaggaagtgttggagccttaatgtgaacccaggcaatctggttcccaagtgtttttttttttttttttttttttttttgagatagggtctcattctgttgcccagggtggagtgcaagtggcactatcatggctcactgcagccttgactttctgggctcaagcggtactcttacctcagcctcctgagtaactgggactacaggtgcatgccaccaagcccagcttattttcatattttttgcagagatggggtcttaaccatattgcttaggctggttttgaactcgtgggctcaagccacctggccgctttggcctcccaagtgttgggattgcaggcgtgaaccaccgtgcctggccactactgagttctttttttttttttttttttaacttttaagttgagaggtacatgtgcaggatgtgcaggtttgttaacataggtaaacctgtggtttgctgcacagatcatcccatcacctaggtattaagcccagtttccattagctattcttcctgatgctcttcccccactcccacaggccccattgtgtgttgtttccccccatatgtccatgtgttctcatcattcagctcccacttataagtgagaacatgtggtgtttggttttctgttcctgagttcttaatgctacactaccatactgctgatcagtggacaataatgtgagtggtttcttcatcttggcagtgtacttttaagtcctctatttaattgtggagtatgtttgtgcatccttataggaattttaggagatagcagaggattgggcaaatctttgatcctcaagattccccagctgtacaataggtgtaatcccatttgccttataggttatttatagagactatatagtaatacaggttgagcatcccaaatccaaaatcttccaaaatctgaaaccttttaagcacccacgtgatgctccaaagaaatgttcattggaacattttggatatgggatgctcaactggtaagtataatacaaataatcccaaatccaaacaatattaatatttggattttggaatatttatgtttgaaacacttttggtcccaagcattttggataagggatactcaacctgtactttttctgggatttttctgtgtgccagataataggctgagggttttgctggcatggtaggccccccagatagctcagtaattccatttattgagtacattccatgtgtcagatacttgaggtaatatactacctttagttattacatgataggggatattatacccattttatggatgagaaaactgaacctaaagaaattcagtaatttgctcaaataggtttttactttgcggcctttgtacttgttgatccctctgcctggcttggtttctcatttctctaggatattttgctcaaatattaccctttcagtggaacgttccttggccatctcattaaaataatatcccttgctttgccagccctcctttttcagtttattttgcttaatattaccatcaaacatacatttacatgagttgtctctttccccactctagaatgttaagtgagaggaaggatatttgtcagccgcctttatattgctttaaccccagcacctagaacagtgcttggagtgtagtaagtatttaatatttgttgagctaatgtttatgtggcatccagggatacactggacttatttgcaagctgatcctgaagtaaactaatttcatatttaacagaccaaaatgggcattccttagaagtgaaatgctgtggcaggtgtttgggcctgttttgggtgggggttgggaggcagttgagtctcctgtagtttttagaggcctattctcatgaattgccttgagttccaggaggagtatatgccttcagctcagcttctaggttctgtagagccttttatctattagtacaggtctcttaaagctgctgcttcttacttaacttgcaacccctcattttgcccaaagattctttgagtgaccatttatagtgtatttgtgatgatcacagcatagagcttgatgtgaagcagagggttagctttgaacagggggatcctagctttgccatttataacttagtaggagataacatagcatacatatgtacatttctagatagatacatatgtgtgtatattttaaaaatgcattgtgctgaaactttcaataattaggttttggttaatatttaatattttgatagcacatagttttttctgacatcttggaatgcataccctttttgtttctgcttctcaaaacatttcttgcaataatgtgtgtagttggaacatagtagtaataatattttactgtactcttgcatccaaatgcaagctgattttggagagaaagagacattggattttagatacttcaaccttaagttgatattatgtaactgtggttcagcagagataagagcaggagatttttttgggatcattatgcatagtgtacattggcttttggtgggggtacttagaattaaagagccggagggtcagaggtgaaaacatcatgcttaacttggcaggaggaagaagtaggatcactgataagagtggtcaaagaggtaggagaaaatttaggataatgtagcatacaatccataagcatctcaaatttgaaaagaatccagatggcatgttctcccatctgggagatgcttttaaattgtatacagtataaaaactgttcttccaattatgtcaagttaaaattatctttaaagctgatatgatcaacaattatccttatgtagattgtttcctttgtcgcatctcatgggaattgggttcttctcccacactgggtcccaggttacaaataataggtttaagctgggaagtggtcagggacaggaagggagggcatatttggctttattgaattctacaaagtcaaatagaattgtattggaattattttacatgcaacattggtattagtgtggctgatcaaagaattgattgtacttaaatatgcaaatagtattaggataatacaatactgcaatttgatgtcctcttcaaaatagctctgaaaaatatgattggaatttctggagtctattttgaaaaggaaaactttttttttcttttttccttctgtacttcatgtgaaataagtgtgtaggcaactactttagtttctttaagttttgtgtaaaagctaacttgggtagaaataatgctggagatgagtatcttataaaaatcacttcatttttctgcttcttgagagaatattttacagggaaattattatcaatatgaaaaatgactcataattctacttttctcattccagaagttttttttcttaattttggtaaaatatatataaaatttgccattgtaaccattttaagtatacagttcagtggcattgagaacatttacgttgttgtgcaaccattgtcaccattcatacccagaatttttttactatctcataataaaactgtacccattaaacaatagggccctgttcctccctccctccctcgctccctcccacctcccagcccctggtaatcactgttcttctttctttatatttgactattctaagtatttcatgtaagtggaatgatacaaaatttgttctttgtggctatttcatttagcatgtattccaggtgatacatgttgtaacgtttatcagaattcattcctttttaaaagtgaataatattccattgtatgtatataccatattttgcttatctactcatcagttgacagatgcttgggttacttataccttttggctattataggcattattcaagcatgaataatggtgacaggaacattggtgtacaaatatctgttcaagtcactgcattcgattcttttgtgtatatacccagaagtggaattgctccacaaatatttgagtacctagtatatggcaggcactgtgctaagcactggggatgcagcagtgaaaaagaggggcctggttcttgcccttatggaatttacagtctagtagggaaaaaagatgttaaataagcagttgcagttaagtgggttaaatgttacaaaaacgttaagcacagagtgccgtgtgtatgtttcatataattgtaataatatatatatgttaagccaaaagagactataaaacatcaaatactttttccccttccaatataatcccctgcagcacctcactacccctggccacctaccacatggaaatgtcttctgctgcttttcttcacatttaaaaatgcaatgccgctgggtgaggtggctcacgcctgtaatcccagcactttgggaggctaaggtgggtggattgcttgaggctaggagttccagaagagactgggtaacagcaagaccctgtctctactaaaaaaaaaaaaaaaaaagccatagtggcatgtacccacagtcctagctactcgagaagctgaggctggaggatcccttgctcccaggagtttgaggctgcagtgagctgtggtcataccactgaactccagcttgggtggcagagtgagaccctgtctttaaaaaaaagaaaatgcatccagaatttactttttttgtttttttgagatggagtcttgctctgtcacccaggctggaatgcagtggcacgatcgtggcacgatcttggctcactgcaactttcgcaccactgcaacctccacctcctgggttcaagcgattcttgtgttttggccttctgagtagctgggattacagtgccaccacgcctggccaatttttgtatttttagtagagatggagtttcaccatgttggccaggctggtctcgaactcctgacctcaagtgatccgcccaccttggccttccaaaatgttgagattataggcgtgagccaccgcaccctgccggaatttacttttgaatatgatgtgaggcagggctgtacactttagtctttttttttttttttgcctttttttttgcccttttttttttttttgccgtatcatgaaccaaaaccaactactttccttgtacatttgtctgtttctatatcctcatttttaggtagcaatacttctataagtagctttatctttttccctatctaattgtgtccagcagttggaatcacgctgtcagtcagcatgaacatttttaaagctcttggtaactgaagttatattgttttctaatagggttgtactgattttacagtgccatcagtgctgtgatacgtggtaaccacattttccctgcttcggagatgttaaacagtccgtgcagttcctcagatttctttaatttgcatttctttgattactagctgaaattaatatttccccttgtttttcagcaaggtattgtgaatgtgactgacaaacttaagtttaacctgagagggccttataaattatgagtatacagtagtttttagtaaattactggcacttttttttttttagtatttagatgtatctactttttttaaattgagtttgtgtattttgtaatgtctgttcaccttatttgtggttctcctagttcatttcaatttactacttaggaaacctgaagtaatctatccatcctcttgtttagcctagtagtgctaagttgcattcagtggatagccaattcgtggatgagctgagttcaagtgttttgtaaatagagtatgagagaatcagtgggaagagcccagatttttttttcttactgtagtgtaatctttttagcagtgaagcctatagtgaaatgagatttttattagtaacttagcctgcttcttgatagtaatagttatttatagtcatgagccggacggataaagtaaaattggctgtttgacataattcttttgaaaaataattatataattgtatttatctttatgccaggtggtagtagtctacataaactacttccaggtaggaagtccgcagtattctccttttggggatttgtcagtaccaaggcattgcagaacctatggaaaaagatatcctttatgatatctgagaatgttctggactagctaactttagagtggttaaagagacactaacaacttagtggtgaaaaattttccaggtgtagaaagagaagttaggggcaaataaaacattgtatagagcagttaattttgtttcctttaacctgtgtcagaaaaagaataattttcttttcttttctttttttttttttttttttttgagacggggtttcgctcttgttgcccaggctggagtacaatggcgcgatcttggctcactgcaacctctgcctcccaggttcaagtgattcgcctgcctcagccttcctgagtagctgggattacaggcatgcgccaccatgcccggctaattttgtgtttttagtagagacggggttctctatgttgatcaggctggtcccgaactcccaacctcaggtgattcgctggcctcagcctcccaaagtgctgggattacaggcatgaagcatcatgcccggccaaaagaataattttcaaacatcctttatagattgacttatttaggaagatagaatgtattatttatagttttgctgaaaataatcatgcatgttacattacatttaaatgcagtgaatggagagccctgttcccctttcagcgtaatcatcttgttttattttcatgctagcatttaccagtacttggtattttctcatttttcttccccctcaatagactttaagctccatgggggcaaaaacttctctcttcaatgttgtaaacatggtgtctctaatagtgcctgatatatagcaggctctcaagaaatatttgttgaatgatttaatttagtgctttatctggatactgatcaaaatattttatttaatttaaatttttttttgaggtgaggtctcactctgtcaccgaggctggagtgatctcagttcactgcagcttctgcctcccagggctcaagtgatcctcccacctcagcctacggagtagttgggcccacaggcacacgccaccacacctggttcattttttgtatttttggtaaaggcagggcttcaccatgttgctcaggctggtctcgaactcctgagctcaagcaatctgtctgccctccttggcctcccaaagtggtgtgattacaggcacaagccaccgtgcccagcttctgattaaaatatttataaataaataaatttagtcttagttgtgaatataactgcatttctgaacctaccactcagattcttaaacatcagtctatgaagcaggaaaaagttttgagatctgagaggcttgtcagtattactgtagaatacaagaaattggagccaaggttaaaaaatacagtctgaagctcattaaatacttttttttttgctctatttaactatgtctgaactcattattggcatgttttcttctgatcagttgtccttacaagttaagacaaccgtttattccttttttttgaaacaaggtctcactttttcacccaggctggagtgcagtggtgtgatcacagctcattgtagccttggcgtcctgtgcccaagggatcctcctgccttagcctcctgagtagctgggactacagatgtctgccaccatgcctggctaatattttttattttttgtagagatggcgtcttactttgttccccaggctggtcattatgtgctttaatcaaatgtaatagtagcaatgattccacgatagttttagtttgcatagcactttcactctgtcttcatcataataatgatcctttagggagggaggtcttatggtattttttattttttatttttagacacgattttgctctgttgcccagactggaatacagtagcaagaccacatagctcactgcaacctcaaactcctgggctccagtaatccacccccttcagcctcctgagtagctgggattacaggcacgctctaccgtaccaggctaattttttttttttttattttcggtagatacgaggtcttgctatgttgcctaggctggtctcgaactcctgggcttaagccatcctccctgctccacagccagcctcttgtattcatgctactttacaaagaaggaattagcctttcagaggagctaagaaacttggcccagggttacacaattagaattagtaatatgaacactgggacatatatcctgtgttctctggttctggttctgtgttttttagaaccatagaattttagaggaggaagaagccttgaagagtagtactctaacctcacatatatatatatcatatatatgtgtcatatatcatatatacatatatgatatatatcatgtatatatgcatgtatctatatatacatatatgtatcatatatgtatatatgatatatatgatacatatgtgatacatatatgatatataatatatgtatatatgtgtgtatatatgggaaatatttatttacaaatatatatgatgttaatatatataataaactaactttataaagctaatatggcagagttaggattccaacccaggtctcttccttagatcagtcctgtgatctttctaatcttccatgtctttgattctggagatgtgtatgctacctgatgaaatgtctgataacaaaggtatttgagtttcttaatagttttctgtcacatgtttgttcttgtaatggtgaatagcttccaaaaacatttgaatttattttgaggcagcttgggatggtggaaagaacttatgctttagagacaagtagatttaagagcacctatgacacctttattgactgtgtgaccctgttgtttactaatctgtaaaatgggcagaatatcatctaccttgaactaaaacatagtgtattatgttgagtgtctgacatagaatgtgctcgataatgttaccattgttttagaaaatgttacagagatgaaatgtacttcattacagtatagaaagggacaactaagatgaaaaaacgttttggaaagcatttgaccaaaggttttatatctgcattcatacagattgatatgaataacttatgattttaaatgttagtgaacatttttttttttttagaatatcttttttgaaacagggcctgcgcagttttctctcaaacttctgggctcaagcaatcctcccacctcagccttctgagtagctgggactggaggtgtgcgccaccatgtccagctacttaaaaaaaaattttttttttaattttttttagacggagtctcgctctgtcacccaggctggagtgcagtggtgcgatctcagctcactgcaacctccaccccctgggttcaagcgattctcctgccttagcctcctgagtagctgggattacaggtgtgcgccaccatgcccagctaatttttgtgtttttagtacagacgggtttcaccatgttggtcaggctgatctcgaactcctgacctcgtgatccacccacctcagcctcccaaagtgctgggattacaggcgtgagccaccgtggtgtcgcccaggctggagtgcaatggagtgatgtcggttcactgcaacctccgcctcccaagttcaggcgattctcctgcctcaccctcctgagtacctgggactacaggcatgcaccaccatgcccggctaattttgtatttttagtagtgacggggttttgccttgttggccaggctggtctcaaactcctgatctcaggtgatctgcctgccttggcctcccaaagtgctgagattacaggcgtgagccaccatgcccggcctttaaatttttttgtagcgacgatatctccctgtgtttcccaggctagacatctatcattttaagttcttcataacttttcaaggaataggtgcaaatctctgcattttacaaatagaaaaaattgtagagatgcatcttgtctttaatcaagagccctaaagtaaatctacttgggtctaataatgagaaaataagggataattcaacataaaatctgtacataggaagcgttgttagttattacaatgaagtgttggggtcagtcttaatgtctaataataaatgagtagattatcacatctggtggaatctcataaaactattagaagtttgtattatgaatattacagaagtgcctagaagtgcatatggagatgaaaagttgtgtacaattgtatccattttgtggttatagttttgaaaaatctacaaagtcatacaggcatatacatgtggacaaaggctgggaaggaaaatgaaaataggtgatttttcagggtattataatgctatgtgattgttctgattatttttaaagataattttgtgtaataaagagggagaaaaccaagatgatatatttcccatgtagtgtgcactgaagagcattggcattaaaacagtcaggggttccacctagatgatgtggtttatagtatattgtatcttatactttgggggaattttaatagtcttgactactggcttttaattttttattagtaaacttttagcatactatcattcaacccattgcattttaccatggagtttcactattattttattattttcttcttcttcttgagaattatggccacaataagtagacttgtatgttatgtaaataaatcttaatggactttttttttttgagaatcttcaacttggtgtcattaaagaagcatttttaagcccgagatatatgttccattgcagtattatgagggaaatcatccattataaacttctatgcccatagctttttgtgtagcttgtcttgtcaatcagcaaagcaaatactttactgctctctgccttccaaattacttcatatattttatggttgatatactttatggtatgtgtgttcttttctgtttcattgcttccataaaaaagactggttgaggtgttagtttgatttcttctctttttccattcatctgtgagtactactacaagacacagtgcaccattgattcttgcattcctcatttacattctgattttaaaagaagcttgttaaaaagaatttgcctgggtaaatggtactatagtcttggtggtttgaaaacttagagaatgctttttcagttgtttcattccagttaagcatattgttaaactgataaggttcattctctctgtgtgtctctgtctatctgtgtgtgtcttgcctgtctctcccaccaccttctcccctcagcccccaccattttgttttaaactaatcttcagggagtatgtccacagtgaaactattcagagttccctgtactgtatgtaattccttggaatgtttgcctttcttgagttgttgtgtattttacagaagtagttagtatccggtagacttaatgagttttgtagcatggtcttcacatcttcaaagagtttttgactgtttagagcatactacttcaaaagaaggaataattttattaataattgtgtaaaaataatgatccctgcccatagcaaaaatttagtacaaaaggggtataaagtgaaagatttcatttcttccattccaagtttttagaagtaaccactgctgatagttttttgtatcctagaaatttcctaatcataaacgaattgaattatatgtattgcattgtaacttgctcttttcactttattatagtaccttatattttacaatatcagcatattttaaagcagcatatacattgtatttataaatctaatcatccccatggcttttagaaatgcaaaaattttatttaaaactcatatatgtatatgtatgtgacttagtgttttttcttccaggaaaagtggtattatataattattttctttttttctttctttttttttttttttgagacagaattttgctctgttgcccaggctggagtgcagtggctccatctcggctcactgcaacctccgcctcccgtgttcaagcagttctctgcctcagcctcccgagtagctgggattacaggcgcccgccaccatgcctgggtaatttttgtatttttagtggaaacagggtttcgccatcttggccaggctggtcttgaactcctgaccttgtgatccacccacctcagcctcccaaagtgctgggattacaggcgtgagccaccacccctggcaattatttctttatactacgttagcctaacatttttttttgttgcattgaggatgtgatttagggcatactttatgttaaaagtgttactggtagagggtcttgactgcaagttgtccaggttcttggcattttgaacgaagaattggacaaaacacacatcaaagcaaggaaagaatgaagcaaggaaagcagatatttattgaaaatgaaagtacactccacagagtagaagcggctggaccagcggctcaagagccctggttacaggatcttctggggtccaaataccctctagaggttttccgttggccacttggtgtacaccccatgcaaatgaagtagtggcctgtgatcagtctgattgattgtggaaagcaagcaattgggggctgaagtgaagttacaaagttacgctcctatgcaaactttgtaactatacaaagtgatactcttaagaaaggtactttcagttttccctctgccacacagaggtactttagtatggagagttacttaggtatggagggttgaggttttccttttgatttagttctaggaagtcagggtgaataggccttattccacctgcctccagaccccattctcttgcctcaaaagaacaaactttactatgtacatattttgatggtgtcttttcagagttgtgtttaagatgcagtttttgttctcaatgtccacagtcttaatacagaaggtagctaatgaaacaaaaatactagaatagagtcattattgtaatgatggaaacttacataaagtataggaacagaaagaggtagtgattatctcagagatttcaaggagtgtgtcttacagaggaggcgtagtgattgaggttcagtagtttatcacgacattccaaaccacctgacctccatctcgcataactctaactgctcttagttccctggggacaccaggctgtttgcctagatatttctttgcttgggctgtttctaatgcctagaatattcctgtacccacttgccagcataacagtacatgtccttccagatttagattgaggttacttgaaaaccatacctgaggtttcctttcccagaagagctactttctggtgccctgaggcttcctaagcatattcatgccagtgtgctttcagtgtaccctatagtaatcacttgtgtgacaccttcactatactttaaattcactggggggagagagtatgttttattcattttccctgaacattttattatgaaaaactccaatgtacataattgtatagtgaatactcatatacctatcacctagatttgacttttagctttttgctctacagtcagcccttcatatccatggttacccatttgtggattcagccagtatttgaaaaaacctgctttaatctgcactgaacatatagagattttttcttgtcattttccactaagtaatatggtataacaatttttttttttttgagacggagtctgactctgttgcccaggttggagtgcaatggcatgatctcagctcactgcaacctccgcctcccgggttcaaatgattctcctgcctcagcctcccaagtagctgggactacaagcatgtgccaccatgcctggctaatttttgtatttttagtatagatggtgtttcaccatgttggcaaggctggtcttgaactcctgacctcaggtgatctgcccgcctctgcctccctaagtgctgggattacaggcgtgagccaccatgcccggcccaacaactattttctttttttttttttttgagacagagtttcgctcttgttgcccaggctggagtgcaatggcgcgatctcggctcaccgcaacctccgcctcccgggttcaagcgattctcccgcctcagccttccgagtagctgggattacaggtgcacgccaccacgcccagctaattttgtatttttagtagagacggggtttttccctgttggtcaggctggtctcgaactcccaacctcaggtgatccacccgcctcagcgggattacagtgctgggattagaggcgtgagcaacgacgcctggccacaacaactattttcatagcactttcattatatttgctattacaagtaatctagaagtgatttaaagtatatgggaggatgtacgtaggttagatgcaaatattgggccattttatataagggacttgagcaactatggattttggtgtccttggggtgtgctggaaccaatcccccatggatactgagggatgactgtatttgttttgtcaggtaccatccatctagcttttgtgctctgcgtttttaaacatgcactccaaagtaagttgcagacattggtgtatgtcacctctgaagaattcagcattaaaatccttaattttatttattattaactctttattttaatccttttttacattttaaaatgtgtattatttttatcatcaggcctaccacagtgctgctacagatatacttaatatttgaattgaaatctcttaaaatttttaaattttactttttttttaaatttccgtagcctttttactttgtgcatttgagtctaagtttactgcactcgaagagatcaattcattgagggctgtagtagggagagtttcatggaacaaatgctgtgtttttcttggagacagggtctccctctgtctcccaggctggagtgcagtggctcaatctcggctcactgaaacgtctacctcccagacttaagcaattctccaacatcaacctcccaagtagctgggaccacaggcacacaccaccatgtccagctaatttttgaatttttttgtagagacggggtctcaccatgttccccaggctggtctgaaattcctgagctcaagagatctgcccgccttggcctccgaaagtgctggggttacaggcgtgagctactgtgcctgtcctatggttttaactggtccttaaagaatgattctgcattgagtacaaagggggtggttatggttacaggctggagaaacagagatgggaatgagtactttccatggaataatgagacaaacattgtgattgaaactgtaggttcaattttattaatagaaaaagcaggtctttggtttttgcaggatcttgttgggattgattatatttaaatataagtgcctaaaaatgataccttgtatttttcttaaacgatacatttttctagttgggtaaacttttgagttatttagactaaaaactgggtggcttagtgtttctgtagaagatagaaaatgaacagaggagccagtcacagtgactcacacctgtaatcccagccctttaggaggctgagtccaggagttcaagaccagcctgggcaacttggtgagaccttgactctacacaaaaaacaatttttaaaaaaattccatttaaagaaaatcggggaagatcccagtggtgagttgaaatctatatggaatgaacttcctggagattttcaatctcgcttaccttaaatttgagcaatacctttcaggaaaggtacattttttttttcttgtggaaagaagagtagtgtggccactggtggcttattctctggaaagcttcttaaggacattctggggaaatgcatcattgagctgtgggttcctggcatttgagtgaataatgttcagatgattaagtggcccaaggcaggaagcagggagaatgtttgcttctcttccctagctactcatacctcctgtttctctaaaactgggtaatcctatatataacaggttgctgattccatgacttagaatagcttttcttaaagtggagtatggattcacctatattaggggatttatgaataatacaaatacctgagacctgtatacagatctactgaatgagtccttggatgtcggacctgtgaccatgcatttaaacgaacattttatatgatttttatgcatattggaatttaagagaactgctctcatataggtggaattttccataatttatttattaaacaaccacctataggcattatgggggagttactgctcctctttaggaagtataattacaggcagtaaatgctgtcttagtccatttgtgttttgctgtaacagaacacccgaggctgggtaatttataaacaaaagaggttttagctcagtgttctacagtctggaaaataagagaagcattgcaccatatctacttggcttctggtgatggttacttgctaggtcaaaacatggtagataaggtcaaaggggaagtggacacattcaaagagagaacccaagggatagcttggctttatagcaacagccccactctcttgggaatgaatccatttccaggagaactaatccagtctcaccagagtgagaactcagaatctcactcattaccaaaagattggcaacaagtcattcatgagggatctgccaccatgacccaaacacctctcagtaggctttacctcccaacacagccacgttggggatcaaatttcaacatgagttttggtggggacaaacaaaccatatctaacccaaagcaaatgcctattgctttataataagattgatggtaaagtgcagctgttggggattttctgctgctcaagattttgctaaagatcgttttgtgtacacaattgtaaggaaactattatttttattgcatgtattgaatgaagagtaagatatttcaggggtttctatgtgatagttttagatagttccttaagtacaaaggaaggaaattaagaccttatgtttgaaattgagtgattcacaatactttaagagtgtagtcttatttttgttctgaagagctattatgtggattatcctagtaagacaagtatatatttatgagacaaatatgtagaagatgagttcaagcctagattcttgcctcttagctgtgtgaccttgggaaaagcttttaacttaaaaacaaattcagcgttgattagtatttaggggaagttgatttgctgtagaaaccatgttatgctattacttgcgtaagtattttggtaacacttctggtattaccatggtagtataaaagcatttttttccctctcgtataatacagaaacaacaacgtaaacaaaaaacctctgcaaactcctatttttagcacacttggagacataaaatgtgccgattacaaaaaatgtgtagaggggccggtaggtcgtgcatcaaagaagtgtggagaatagtgagctggcccagagatggtagatcttagaaagcttgactgtaaaatacaataatatcctttgtatgtgacaatgggagcaggtaaagagatgagcaggctacaagataaagcctttatggaaaaggtttagtcacgactagggagatatggtagggcttttgcacaacgaatccgttttagcaggaaatcatctctgtggaagcagtggagagaacttttgacttaagaagcctgaaaggctatttatcctaacatataaagagctctttggagtcagtaagaaaaagatcattagcagtggctcacgcctgtaatctcagcactttgggaggccgaggcgggtggatcacgaggtgaggagatcgagaccatcctggctaacatggtgaaaccccgcctctactaaaaatacaaaaaattagctgggcatggtggcgggcgcctgtagtcccagctactcgggaggctgaggcaggagaatggcgtgaacccgggaggcagagcttgcagtgagtcgagattgcactgctgcactccagcctgggtgacaaagcaagactctgtttcagaaaaaaaaaagaaatcattagcttgttaagaaaatgcaagcagcatttatgaaaaagataatatgaatggcgcttaaataagaaaaatagagaagtgcttattaaaatgacagatatcccttcttagacctgtttggttcctgatttccttagcaagagttcagatagtgattaatactgcattatccaaatctgtttggttgatgttttgagtaacaagggatttattgaaaatgtatgcttggttcctgagattgtgaagtagaattttgtgtagggaggttcaccagtatcctgaataccactgttcacttagcagattgccaaaaatctctaaagtcttgacagcactgttggtgactgtatagaaactgacagatccgtacatacattgccggtggaagtataattcgatataacccccgaacatggagggcaattttgatatctgttaaaattacaaatgcatatcgcctttggccaatgccttcaatcatgtttcagtcagtatgagggactacttatgtgttaattggttaaaacaatcacagcaacatagaattaaatattaaatattattcagatagctgaaacagatagctttgaggttccaatgtagatgttgatgaaataacatcagaagaaagcatttgagtatgggcaggcgaacactgatggacataaattaaaaaattaagatatttatatacagtctaatttacactttttagcggatagttctgggagttttgacaaatgtatacagttgtctaaccatcactacaattaagatatagatcagttccagtacctctatttccacatccctccaatattccttggtagtccttctttcctccccaaccatagcccctggcaaccactgatttctttctcatttatatgttttttttgctctttccagactgtcatatacatggagtcatatagtaagtagccagttgagtctggcttctttcacttagcataatgcatttgagattcatccggggtgttgtgttagcagaaatttgttcctttttattactgagtagtattccattgtatgagtataacataatttgcttatccatttaccaccagttgaaggacatttgggttatttctgcttttggtgactacaaataaagctgcctagaagttttgatagttttaggtttttacatttgagtctagcatccattttgagttaaatttttgcatatggtacaaggtatggaaagaattaactttttttgacatatggatatccagtcattccagcaccatttgttgaaaagactatctttcttcattgaattgccttggcacctttgtcaaaaatcaaatgaccatatgtgtgtaggtccatttcaggactttctattctatttcattgatctgtcttgatcaccattcgcactgtcttaccgtagctttatagaaagccttgacatcaagtagtgtgagtcttccaactttgttctttttcaaaatggttttggttattctaacttctttgccttttcacctaagaatcagcttgctgattttgaaaaaaattttagtagaattttgatgagacagatttctaaaaattgtggtagcatatatataacaaaattttctattttaacttttgaagtgcacagtttagtggcattaagtacattcacattgttttgcaactatcgctaccatctgtttctagcaacttaaaaaattttcccaaactgaaactctggacccataaacaatgactccacagtggaggaccactacacccagcacctggcaaaccaccattctactttgtctctttgaatctgacacctttaggtacttcatcccgtatttgtagaataatagaatatttgtccttttgtgactggcttttatttcacttagcccattgtcttcaaggtttatccttggttggttggttggtttttgtttttttgagacagagtctcattctgtcacctaggcgggagtgcattggcacgatctcggctcactgcaacctcctccgcctcccaggttcaagtgattctctcgcctcggcctcccaggtagctgggattataggcacccgtcaccctgcctggctaaattttgtatttttagtagagacaaggtttcaccatgttggccaggctggtctctaactcctaatctcaggtgatccgcccacctcggcctcccaaagtgctgggatcacaggcgtgagccactgcgcctggtcccttgttgtttaatatgtcagagtttataatctattgtatgtatataccacattttgtttgtccattcatctgttgatggctcctcgggttgcttccacattgactgttgtgaataatgtcgctatgaacatgggtacataaatgtctttttgagtgcttgctttgaattctttggggtatatgcccagaagtgcaattactggatcatatggtaatactgtgtttaattttttttttttttttttgcgatggagtctcactctgtcacccaggctggagtgtggtggcatgatctccgttcactgcaacctctgcttcccagtttcgagattctcctgcctcagcctcctgggtagctgggattacaggtgctcgccaccatgcccaactaattttttttttttttttaagtagagatgggattttgccatgttggccaggctggtctcgaactcctgacctcaagtaatccacccgtcttagcctctcaaagtgctgggattacaggtgtgagccaccacgccctgccgtgtgtgtgtatgtgttttttttttttttaaggaacagttatatcgttttccacagttacatccccacagtttcagtttctccattttctcaccaatatttttttgtctgtctatccatctatctatctatctatctatctatctatctatctatctatctatctaactaactgatggccttcgtaatagatatgaagtcaaatcttaatgtgatttgatttgtacttccctaataattagtgacctgagtctctttcaagtgctttggatagatttttaaatatagttttaaatattcttataaaagttgtatatgtacattgtagaaaaaatctacagataactaaaaataagaaagcaaaaccaggccggacatagtggctcatgcttgtaatccaagtgctttgggaggccaaggccgggagtatcacgagaccagcctgggcaacatagcgagaccccatctctacagaaaatgaaaaaaaaaaattagccaagcatggtggtgcctgggtgcatgtctgtagtcccagctattcaggaggctgaggcaggaggatcacttgagcccaggagttcgaggtgacagtgctctccagcctgggtgacagtgagactctgtctctaaaaaaatagaaagaaaataaaaccatcctgtttttatctttcagacatttttctatacacatatatatgtgccattaaaaaagaaacaccccttcagagtagaggaagcagagagacattattctatacatgtgcttttgtgtctgtcttgtctttttcttccctccttttcttccttttttatttagctccaccatttcatgtcagtaacatttaattttaatgcccagtccacattcacatttctccaagtattcataaacatgtatcatatctggtttatccaaaccatacatgcattgaatctggtttctctctccctcctcctaccctcctccctcccccttctctccctgtctctctcagacaggatctccctctgtcacccaggctagagtgcagtggcataatcatagctcactgcaatctcccaacttgtgggttcaagtgattctctggcctcagccacccaagtagctgggactacgggtgtgtgtccccatgtatgcctaatttttttgtttgtttgtttgagacagtcttgcctctgtcgctcagggtggagtgcagtggtgctatctcggctcactgcaacaacctccgcctcctgggccaaagtgatcctcctgcctcagcctcctgagtagctgggactagagatgtgtgtcaccatgcccatctaatttttatatattttgtgtagccggggtttctgcatgttgctcagactggtcttgaattcttgggctcaagtgatccacccacttggcctcctgaagtgttgggattacagctgtgagccaccctgcccggccatagtttttttttttttttattttttgtagcgacagggtcttgctatgttgcccaggctggtcttgaactcctggtctcaagtgatccttccatgtgaatctggtctcttaagcctcaactctaataacctagcacagctcaccctccttttatataaactacagtcatgtgctgaataatgacgtttcagtcaacgatggaccacgtacagcatgatcgtcctataatattgtaatggagctaaaaattcctttcacctagtcatgtcgtagcctttataacgtcttagtgcagtgcatttctcatgtgtttgtggggatgctggtgtaaattaacctgccctgccagttgtataaaagtatagcacatacagttatgtatagtacataatacttggtaataactgtgttacttgtttacatatttactatttatcattattttagaatgtactattacttataacaaattgtggccaggcatggtggctgatgcctgtaatcccaacactttgggaggctgagacgggaggatcagttgagcccaggagcttgagatcatcctgggcaacatagtgagatgccatctttacaagaaaaatacccaaaaaaattagccagacatggtggtgcatgcctgtagtctcagctacttgagaggctgaggcaagaggatcgcttgagccagggagttcaaggttgcagtgagcagtgatcacaccactgcattccaccctggatgagagagtgagacgagaccctgtctcaagggaaaaaaagaaaaagttaactgtaaaacagtcttaggtccttcagtgggtattccagaaaaaggcactgttatgacagatgacagctccacatgttattgtccctgaagaccttccagtaggacaagatgtagaagtgtaagacagttatattgatgatcctgaccctatgtaggcctaggctaatgtatatttgtgtcttagcgtttaacgaaaaagtttgaaaacaaaacaaataaaaattttaaaaatagaaaacttacagaataagaatataaagaaagtatttttctacagctgtgcaatatgtgttttaagctaagtgttataattaggagtcagtgtaaaagtttataaaacaaaaaagttacagtaaatgaagtttaatttattattgaagaagaaaaaaaatttttttttctttagagacggagtcttgctttgtcacccaggctggagtgcagtggcgcaatcttggctcactgcaacctcggccttctgggttcaagcgattctcctgcctcagcctcccgagtagctgggactacaggcgcgtgccaccacgcctggctaattttttctatttttagtagagatggggtttcaccgtgttagccaggatggtcttgatctcctgacctcttgatccatccgcctcggcctcccaaagtgctgagattacaggcgtgagccactgcacccggccaaaatatttaaaaaaatacattcagtgtctcctaaatgtacagtgtttataaagtgtacaatagtgtctagtaatgtcctagaccttcacgttcactcaccactcactcactgactcactcagagcaactttcagtcctgcaagctccattcatggtgagtaccctatacaggtataccattttttatcttttatatggtatttttactgtacccttttttaggtttatatatgcttatatacacaaatacttaccattgtgttagttgcctacagtatttagtacagtaacatactgtataggtttgtagcctaggagcagtaagctatgccatgtaacctagtgtgtagtaagcctaggctataccatccaggcttgtgtaagtacactctgtgatatttgcacaacgacgaattgcccagtgatgcatttctcagaacttaccccattgttaagcagcacatgactatatattgaggtataatttacatacaatagacatcacccatgatatatactcccttgcaaccatccacaacaatcaagataacatcatggctgggtggctcacacctgtaatctcagcactttgggaagctgaggcaggagtatcgcttgaggctaggagtttgagtcaggcctaggcagcaaagcaagaccctgtctctacaaaataaacacacaaaaacacaaaaatattagctgagcatggtgggatgcagttactgaggagggaggatggcttgagcccaggaatttgaggttgcagtgaactgtgatcatgccactgcactgtagtctgggcgacagagggagaccctgtctcaagacaacaacaacataaaaaccccatctccattaccctcaagtttcttcttgcctcctttctgtcaaggtagattagtttgcattttttgtaatttagaatttcatataagtaaaatcttacaatagtagatacaccacagtcttcatataatcccaactctttgggaggccaaggcgggagcattgcttgcactcgggagttataggtttgaatatatcctaggtgattttgtatatttgttgtatctttcctgtagatacgttagtgatgataaagttaattcctggcttagggtgatgactgtccaattttcttattgtactgctaggttttcaccttatgagtagaaaattacctgtgtggttttacttgggaactaaaagatggccagttctgcgtcagccatacacctgattttttttgagacgaagtttcactcttgttacccaggctggagtgcaatggcgcgatcttggctcactacaacctctgcctcccaggttcaagcgattctcctgcttcagcctcctgagtagctgggattagaggtgcctgccaccacgcttggcaatttttctttctttctttctttctttttttttttttttgtatttttagtagagacggggtttcaccttgttggccaggctggtcttgaactcctgacctcaggtgatccacccgcctaggcctcccaaagtgttgggattacaggtgtgagccactgcacccggccacacctgattttttgtttgtttgtttttttgaggtggagtcttgttctgtcacccaggctggtgtgcagtggtgcgatctcggctcactgcaacttctacctcctgggttcatgcaattctcctgcctcagcctcccgagtagctgggattacagggatgtgccaccacgcctggctaatttttgtatttttagtagagacagggtttcaccatgttgaccagggtggtctcaaactcctgacctcaagtgatccactcaactcagcctcccaaagtgctggattacaggcgtgagccaccgagtccagcccacacctgatatttttaattacagttgctaatcttgtttgcgtcactgatttcattgttagttagggaataatttccaaaatcactcctgtattcactggcttctttagttttctttcatcaactgagattgcttgttacctgaaatataatttttttttaatatattttttgagactgagttttgttcttgtcactcaggctggagtgcaatggcgtgatctcagctcactgcaccctccaccttccgggttcaagcgattctcctgcctcagcctcccgagtagctgggattacaggcgcctgccaccacgcccggcaattttttttgtatttttagtagaaatggggtttcaccatgttggccaggctggtcttgaactcctgacctcaggtgatccaccctccttggcctctcaaagtgctgggattacaggcgtgagccaccgtgcccagcctgaaatataattcttaatgaaaaggtagggtaaatacttaattttttcctttagttaccaattttcaaattaaggtgttaatttagtaactataatgataacatagatttgttcttttatctttttttgaggtttattatagatttttattggtttaatatattttaatacactatagtcatgtgtatttgtttttgatgtattttaaaaatcagtttatattgatactcctgatgaaacattttttgctttaacttttttatggtaaaatacagataacatatacatttgaaccatttttaagtgtacagttcagtagcattaagtgctttcacatttgttgtgcagccgtcaccaccatccatctctggaactttttcttttttgaaaactttctagaggttcatatttattggcatttgacctagagtcttcctcatgggcaaggtgcagccctgggcaggactatcagcatcctgctgtctcctcaattctgttaatccaccaatcctaatccctcctaaccccactcatagtccagagaagataaaaagttcagggacatggtgtactgctctccagatcctttcccagctgaaactctatacccatttagcactaatttcccattttccctagcccaagataaccaaccaccattctactttctctttgaatttgactcctaggtacctcacatatatattcctatttagtggaattgtagactatttatccttttgtgactggcttatttcacttagcactgttttctaggttcatccatgttgtagcttctgtcataatttccttcccttttaaggctgaataattttccattgtgtatatgtaccatattttgttcatccattcattcattgatagatacttgagttgcttctaccttttggcaattgtgagtgatgctgttatgaacatgggtgtacaaatgtctgttttgagtccttgttttgctttcgtgcattctattaaaaatgttaaggttctttgctttttacttttttttctcttttatccaccttttgactttattcttaaagttttatcttggtataataatttatggtatgttgcagaattaggagcaaagtcccgtgtgtccttcactcagtttcccccaatggtaacatttttcataattacagcacaatgtcaagaccgggaaattgacattgatacagtccatatacaggtgtcccttggtatctgtgggggattggttccagaaccctcgatgataccaaaatccatggatgcttaagtttattagataaaatggcatagtgttttcacataacctacacacatcttcctgtatactttaaatcatctttcgattacttataacacctaatataatataaatgccgtgtaaatagttatattgtattgattttatttgtattttttttattgttgttatttttcattgtgttttttccctgaatattttctatctgtggttggttgaatctgagcatggggaacccatggatatggagggctaactgtatttattcagatcttgctagttatacatggactcatttagataactatgtttgcatgttttatgtgtataattctatgcagttttatcatgtgtggataggtgtaagcactaccaccaccatcaccatcaccatcaagacacagaactgtcccatcatcacagatatccctcacactactcatttagttacactcactcccccaccccttctctccttcctctatttggtttctaatctgtgtcaaccactaacctgttattcataattttgacattttcatggagtcatataaatggaaatcatactgtatataactattgagtttttgttttgttttgtttttgcatttagcatagtttccttgggatccatccatgttgttatatttcagtaattcatttctttctattactgagatgtagtctgcggtacagatgtaccacagtttgtttaaccatgtactcattgagggatttttgggtttgtattagttttttagggctgcctaacaaagtagcacaaactgggtggcttaaacaacagaaatttattgttctggaggcaagaagtccaagatcaaggagttggcagggttagttccttctgagagaatctattctgtccccctctcttagcttctggtggtttgctggcaatctttggtgtcctttggctggtagaagcattacctcccatctctgccttcattttcacatggtgttctccttgtgtgtatgtctctttgcaaattgtccttttttttattagagtaccactcatattgcattcctccctaaggacttcgttttaacttgataacttcagtaaagatcctgactccaaataaggtcatattctgaggtactgggggataggacttcaacatatgaatgtttgggagacacaattaaacccatagcagagttgctttcatgttttggctattacaaacaaaggtcctatggatgtttatgtacatgtttttacgtagacataggttttcatttctctgggataaatgctcaggtgtaaggttactggtggttatggtaagtgcatgtatggtttttaaagaaacgtctaagctctttgccagagtggctgtagtttacatttccaccagcagtgtataagaatcagtttctctgcatctttgctatcatttggtgttgtcactattttttttttttttttttttgagagggagtctcgctctgttgcccaggctggagtgcagtggcacaatttgagctcactgcaagctctgcctcccgggttcacaccattctcctgcctcagcctcccgagtagctgggactacaggtgcccaccaccacgcccggctaatttttttgtatttttagtagagacggggtttcactgtgttcatcaggatggtcttgatctcctgaccttgtgatccgcccacctcggcctcccaaagtgttgggattacaggcgtgagccaccgtgcccgggctgtcactatttttttattttggcaattcttacagatgtagtgatatcatgttgtggttttaatttgtgttttcttctattcagtttaacatgtgttttaaaagtttgtttgctaattatctcttttatacttaatatcttgattcttagggtcattaacaagattgcttgccttctcctatagtataaagaaaataacttcagaaaaacagaattagtgtagcagacaacagaagtattgtatgaagtttaattttctttccttcttttttttaaaaatagagacatagtcttgctctgtcacctaggctgcagtgcagtgacctaatcacagctcactgcagcctcgtactcctgggctcaagcgatctctctctctctctctctttcttccctccccctccaccctttccccctctcccttccccgctttcctccctctccctccctctccttttttgtagagaacaggtctcgctgtgttgaccaggctggtctcaaacccctggcctcaagcgatccccccaccttggcctcccaaagtgctgggattacaagtgtgagccatcccatcctgctttaaattttcttctttttgtccttaaaattcttcccactaaggataagcaaagtgttgtgttctgacctcactttatatgaatactttctctgtatgtctgtgttattgatttgatgtacatgattaggtttttttttccaatttgtctttaatttcagaaatttctgtttctatgacagtgacataacctaacaaaattcagtttcatttgaatgagtatgacattttccttattcaaaagttaaaattatatgcaaaggtatatatagaagtcttccacagattcctgtctcgtatatttcttttatcatcccttcctccttacaacttggaaaaagtgtttcttgttaatcctctcagtatttttttgtgcaaacaaatacatccattcatatacatgttcttactttgtgaaaggcatcacattttacattatattacataatttgatgtaaacttaaatattaagtagcagacctaacagaagactttcagagttgtgttaatgctgttttttatgttgtgagagttgaatctgctacactgacttccacattattttgtgatctatgagttatgatcaacatgagatagtaggttcactagtaactaagttcaagtatgtaacactggaaaaactgcttgttgctttatgactttgggcagaaaaacagacaggtgaaatgcagttgaatactttgtaaattatggttagccaaagtaggtgacataggactaacctgtgaaaggggacataatgaagtaaaacattcaagtaaaatgacatgataatggcatatttggcaaacatcttcagaatagattatatgtagaagttggaggagaaaagtttttccctttcctagttgcaatttattattattattaattttctttctttttttttttttttgagatggagtttcactcttgttgcccaggctagagtgcaatggtgcgatctcggctcactgcaacctccgcttcccaggttcaagcgattctcctgcctcagcctcctgagttgctgggattacaggcatgcgccaccacgcctggctaatttttgtattttagtagagacagggtttcaccatgttggtcaggctggtctcaaactcccgacctcaggtgatccgcctgcctcagcctcccaaagtgctgggattacaggcgtgagccaccgtgcccagccctattattaattttttagagacagtctcgctgtgttgcccaggctagtttcaaacgcttgggctcaagtaatcctcctgcctcagtctcctaaagtgctggattaggggcatgagccaccatgcccagctgctagttgcaattaatttattaatcaggatagctaagcacagtcatttatggtgggtggagggagacagagggagagggagattgtgtttcatgatgaaaagatcattttgagtatttttgccaaaataataatcatagaataagatggagatccttgcatatgaataatcttctcaatcatgttgttctcagtgttgctacgttatttggcagataactttttgccaggaggataattataacacatttttttttgaaagagttttctaattgagaagtttctttcctgactaatgacttaacaaataaaccattgttacaacaaactgtgtcataacagcaaagttgcaataactatgaatctaagatagtttcaagttctctgtagtagagtgtactttcaagtctatccaaaacaaaaacgttagctctaatatatatttgtttttaataatatattgctcttaatattaaatatatgttgagtcattatttcgcctcctttcttagcatctcgatagttcttttggggatattgattttgcaggatgctttaatgtatttgttgttgtttagaaataaggcagtcttttggtcatagttctagggaaggtttaaaaacttcagtcatcttagagctcagattgagttggtctgtttggatggcatgctaaagtatatgaaatttgcttggttacagggcaaaatgtgagagtcccctaatgatatctggtaccagtaatctaaccaggtaggtaggtaggtaggtaggtaggtaggtaggtaggtaggtaggtaggtagatagatagatagatagatagatagatagatatctcttcttactggatctttttcatgctgtatgcttcctctcgagtttaatggaatcaagtgttgcattttagggtaattcctaaatcttagtatcatcacatgaggccatttagtatgctaaccgttggatgcagttagtttgcgttgctgctggaagattgttgctgctttttaccctggctttaagttgtgtgctcttgtgggtaactatgggacttgacttgtactgtcatattttgaacaagggaaataaatgtttaacatttgttaaataggtttcaatgacagttttcatactctatggtgagcaacttaaatgtaaggttagctctggttgttcaagtgtttccatgtttttttggaaaagttagattatttcttttgatattttgctgtaaatttaacataagctttggtgcattttaccttattaaacgggagacaaaaagtctcaaaatattctgagtgtagatatcaatgattagtgtcttaatttacaaaatgacatctcaatagatcagtagttatatggtatgtggtatgcttgtttagtagaaaggtgttcttaaatgatcgatgatttaagtaaaatcctgtgagtttataccatatgagagaagcttgcttgataaaagaggtttcaaatttaattttttattgtggtaaacaacaacatttaccatttaaccattttttaagtgtataattgagtaacgttaaatatatccaactgctgtgaaacagatctacagaaatttttcatcttgaaagccagaaactctatacctattaaacaacaactcccgtttttctcttcccctagtccctggtaaccattctactttctgtttctatgaatttgactacttcagatacctcataagttgaatcatatggtatttgtcttttttgtgactagcttatttcagttagcataatgcccttagggtccatccgtgttgtaatgtagtacagatgttccttccttttaaaaggtgtgtaactcattttatgtatctactacattttgtttatccatatctgttctattccactggtctatttgtctttatgccagtacctcacagttttgattactgtagctttgtacagtaagttctcacttagtgccgttcttaggttcttggaaacttgggctttaagcaaagcggtgtacagcagatctttgaacaatatcaatttgttcagtgttgttttgttataatgttgatgaggaaaaaaattggtttcattcattatacgtcattttgcttaacattggagtttccaagaacctgttggtgatattgaggactttctctaaaatgctttgaaattaggaagtgtgagtcctccaactttgttcttttcttcctaaaattgtttgggctttttggggtcccttgagattctatatgaattttcagcttaatttttttcatttttgcaaaaagtgctattggaattttgatagggattgtgttgaatctgtagatttctttgggtagtatggacttcatgataatattaagtcttcgaattcatgaacacaggatgcctttctatttgtgtcatctttcatttcagcagtattttgtagttttcagtgtacaagtcttctacgtgcttggttaggtttagtattttacagtttttgatgctgttgtaaatggaattgttttcttaatttcctttttggattgttagtatatacaagaattttgtgtgttgatttaatatcctgcgactttattgaatttgtggttattagttctaagagtttttatgtgtgtgtaaactttgggattttctacatataagattgtgtcatctgggaacagagataattttacttctttctttctttctaacttggatgccttttatttgttacttttcctgcctaattgctttggctaggccttccaatactatgttgaatagacacgtagtgggagtgggcatccttgccttgttctgtatgttagagtaaaaactttcagtcttttacccttgagtataatattagctatgagtttttgacttttactatgtagagatagcgtcttagtccattttctgttccttacaacagaatatctgaaattaggtactttataaagaaaaagaatttatttcttacagttaaggaggctgagaagtccaagttttgagggtccacatctgatgagagtcttcttgctagtgggaactctgcacagttcctaggtgttgcaaggcatcacatggcaatgggactgagggtgcttgctcaggtctctttctcttctaaagccacctgtcccactctcataactattaaatcattaatccagtaatccatgaatggattaacctattcatgatggcagagccctccttacccaatctcctattaaagaccccacttctcagtactgccacattggggattaaatttccacgagtttttgaggggacaaatattcaaaccatagcaggtgatttttttctagttttaacttgagtgttttttatagtgaaagggtgttgaatcttgtcaaatgcttttcctgcatcaactgagatgatcatgtggtttttgtccttcattctgttgatgtcctgtgttacattgattgatttttgtatgttgaaacagtcttgcatttcagcaataaatctcacttggtcatggtgtataatattttaaatgttttaaatgatgaattctggtttgctagtattttgttaggaattttcgcatcaatattcatcagggatattggtctgtagttttcttatagtgtctttttctggcttgaatttaatttttaaaatgtaatttgcatgccttactctttgtctaggaatgtttaagattagagagaattaaaagaattttagagtaccacatatgtgtctcctgttgttaccactgtgtggaattaccaagtgaagaatcaaactcttagatctgaaatacgaattgggaagtactatagtgtgttgacaaactgaattatgaaagcatatttgatttctgaacttgaatatgcatataattcaagcctatgaattgtgtactgtggttgttagctaaaaggttagtgggtaatatcaagtggctggtaatgctaaatattttaataaggtcagctaatcagaagtgaaaggaacaaaaaaattggacatgtgacatatatgtgttcttatatagtcatgctaaaatgaaaaaagaggcattacatattaatagtcaccacatttttaaattttgggttaaaatttttcattctctataaagtggtttatttttcacattggttttattgtttttaatctactgaattgttttttggctacagttctatcttcattatcatgcaaattattaataaaaattcagtaattcattgagatactttttactaccttgagtaaataaatgtgaaaacttgtgatgtaatctattgagagtatgtgaaatgaaaatttagatttcccccaacatcaagcaggattatcctgtgttcatctactcttctatgaaatctgcctttttttgaaatttgccagtgagccagtgatgcccagtgtgaaatggtttagatggcaataatatattgtgcttatatcatgctgtataccatttaacccttcttgtaaatttgatttttggatctggatattcatttataccagctaatatggtctcattggaaatgttgatagccactacaccaagttgtaattacccatgtttatttgttatgtcttaacattacaaattgacatcacaagttacatcacaaagttatgttaataagatggagatgtatacacatgcacacacacacacacaaacacacacacacacacacacacacgcacaccagtccagaaagctaactgtagaatgtggtattcagatataagtgagatgaagagtggataatgacagtattaaaacaattattagctattgaccttggcagactgagaaatgattttaaggtgatagtatatgataaaacaaatattctatctgttttgatatttgtcttaggatagagccagataatgtctagtcagctgcagcttattagggctgactggggaaaatagtagtcttcaaattagatagcagatatgtatccaatatgtcaactataatatggtatccagtgtctagcagcagccagtgccagtatggtcagacagatgagaggacaatattgcggcattcaggttaaggcaactcaagagacaaatggagactttttagggtgggtttatgggcaggattccagtaccagaatgaaggtagatgtattacagcaggaacatgtcagacggggtaggatctttgggtgattcaggtacaggttacaattgagtactgagcacaagttggctctgtgggaataggacataagccttttcttgtctccctccaacccctaactaagggggttgctaagttcacaaggcgtgctaggttttctacagacatcaaaaatggtcattgagaactgggacagcctgagtatgtaggtttgtcaaggtgatcacagttgtggtgatggctcgagtcatgttttgaaagtattggggaaagtgagtagacaagaaaactaggaatattgctgtgcacctactataatacgcttaaaaataggaagggagcaggtggatgtatcccgttttgtaaattttagtttctggcagtgtgtagtgatgctgtatctgtagactgccccagcttgctccttccccaattcctgaaaataaaagttatttttgtaatgttgtggccttaggcctgttcagtttgtctacttagttattttagaaaggccttttactttggcctccttccatcctttatatatatgtatgtataaaatttttttttttttgagacagtcttgctctgttgcccaggctggagtgcagtggcacgatctcggctcactgcagcctccacctcctgggtttaagcgattctcatgcctcagcctctggagtagctgggattacaggcctgtgccaccatgcccagctaatttttgtatttttagtagagatggtatttctccacgttggccaggctggtctggaactcctggcctcaagtgatctgcctgtcttggcctcccaaagtgctgggattacaggcctgagctactgcacccggcctgtcctttatattatttttaaagtttgtaaatatagatttcctactattagttaggaaatatagacagggtcattaatcttcttacatatgcagatttcttccaggcatgccttctctggtttacctattcctgtaccagagcagggactaccattaggaattctgtaggactccatccaggtttgtgtaaaagaaaagatatttgcgaatgatatatgtggtagctgtaatgtgagtgtgttgtcaagaaacttttaggttaagattttactactgggctgagtacacatgatcattgcttagtttgacgtacttttctttttttttttttttttttttttttgagacggagtctcactctgtcgcccaggctggagtgcagtggcttgatcttggctcactgcaagctccacctcccgggttcacgccattcttctgcctcagcctcccgagtagctgggactacagacccccaaccaccaagtccggctaattttttgttgtttagtagagatggggtttcaccgtgttagccaggatggtctcgatctcttgacctcgtgatcctcccgcctcggcctcccaaagtgctgggattacaggtgtgagccaccgtgcctggcctagtttgaagtattttcaccatgtcatttacttagaatagtatagcacaaattagggagattaacagagggaggacaaatatcttttaggtaagaagaatttcttttttttttttttgagatggcatcttgctccgttgcccagtctagagtgcagtggcatgatcttggctcactgcaacctctgtcccccgggttcaagcgattctcctgcctcagcctcccaagtagctgggattacaggtgcatgccaccatgcccaactgatttttctattttagtagagatggggtttcaccatgttggtcttgaactcctgacctcgtgatccgcctgcctccacctcccaaagtgctgggattacaggtgggagccaccacacccggccgaattcttgttaaagattgttactcatcaaaggggcagtagtttttttctttttgaaggtagatatttatgtccacattttgggttagcttttcatttttttgcccgcatgtacatcatttgacatagaaatgatagtaactttcctgtttggatcaaatgtactactgcaggaagtagtctaccttttagcattcacaacctcaaactaaacaacagacttctgtatgctgtctcctgagaaagtacataggccaataaaaggaacatacctttgggtcttgttgtcaggagcctgtaagaaagtttatgttccctgctaatcttgagtaggcaaacataataaaggtaattttatgatagaactcagagtttttgtacatttaattttatatgattataaacatgaaatatgaatagattttagcagcatagttttgtaattccttaggtagcttaggtttttaaacagttttttttttctcctgaggacagtctcactctattgcccagactggagtgcagtggcatgttctcagctcactgtagccttgacctcccaggctcaagcgatcctcccacctcagcctctcaagtagctgggactataggcacgcgccaccatgcccagctagtagttcacgttttaacagagtacattaaaaactgaatttccccttcataatttccttttttgtactaacaataagattgtaaataaaaaattaaaaaattacccaccttgatttgttactgtattcctttgcttcttttttgttgttattatgtctgtttacccacattggtacacagtcataaatagtttcagtgtatgaatattacattaattacattgatgtactatcagtggtacttggttggatgaatttttagtatttagaagctttaaaaatcctatttcactagaatagggagttggccaggtcaataattttttctgtgtctatcagaccttgacacaacatttttttcttttaaaattatatgtacctgtctgggcgcagtggctcacacctgtaatctcagtactctgggaggttgaggtggacagattgcttgaccctgggagttcaagactagcctgggcaacatggtgaaaccctgtttctacaaaatacacaaaaattagctgggcatggtggtgctcgcctatagtctatggataattggacattttggtaattcctaattttaagtgtttgtattatagtgatggtggcattttagaagggtgtatacatttcctggatgtgatccttacatatagaagtatgtgacccttttgggaggagtgttaagggtatggcatgtggtgtgtgaatttgccagcttttagcagttgaatatttctgcatttttagtgagagaattaacataccagctacttaagtgttcccctcccctgtgctctccagtaatatattattaatatatggattctggggaaccttgttagtgatggctttgttggtagcttttcatttttttgtcttgagaccacttgggattgaattaaatacctttttttttttatggagatggagtctcactctgttgcccaggctggattgcagtggtgtgttctcggctcactgcaacctccgcttcccgggttcaagcgattctcctgcctcagcctcccgagtagctgggactataggtgcacaccactgtgcccagctaatttttgtatttttgttttagagacgaggtttcatcatgttggccagactggtcctgaacccctgacctcgtgatctgcccgcctcagcctcccaaagtgtttggattacaggcgtgagccaccgtgcctggcccctaaattaaagacctttaaaacagtaattattttggggggaaaaaaattaaatcatatcaaagcaagatattaggatgttttgtgtgtgcttttattttgttggggggtacttttgatgaatgtaggaagtcattctttttttggagttgcaaagattcaagcatcatcataatttttacttgcttgtattaatgtgctatagtaataggtatctgacaggtgtttcttgttattgaatttaacttgtaatctaaactttgagtaacagcccataaatatatactaattatggataacctgagaagttacggtgattaagtttcagcttttaggtctgtttatattaaaagcagtgttacttgaatttaatatttagaattagaaataacgcgatcatctgttactttttaatctaataattaatagcctttaatggcagctcactatacatgtgaacttaagcaagtagttttactttaatatatattgtttagcttatctacaaatgggattgcctggttttcagtaaggaaaagcagaagctagttgttgctggataggtttttttcccagaaggaaaatagtgattgagacttaatgcaaattttatttctatgctttatcctccaaagctgttagaatgttaactcttttatagtaggtatagagaattgttacatatgatgaaaacctcaaaagttttttctagacactaggagagagctccaccttgtgatcttggagcatattttttaaaaagttaataacccgcaatagtgcagaaattgtttggtgagtttgatttttaaactgatacttttctttgagcattacatgtttttatagttttgggttacccagctgaagtcaaatggtattaagcacatttgaagatactctgaatttgttaatgtaagtctgtgggggaaacacattggatggatggatggatggatggatggatggatggatggacagacggacggatggatggatagatggatggattgacagagtcttaccccattgcccaggctggagtgcaatggtgtgatcatggctcactgcagcttctacctcctgggctcaagcaatcttcctgcctcagcctcccaagtagctaggtctataggtgtgtgccatcatgcccggctgattttttgattttttgttgagatacggtctcactgtgttgtccaggctggtctcgaactcctgggtttaagccattctccaacctcatcctcccaaagcgctgggattgtaggtgtgagccatcatgcatggcctgcaaattgtatttatatgcagctgtagacatttaaaataaagatgtaaacattctcagctcttcctgtagattaaagtttacatttagaaactactaatcccaactcatccgttgggttccttcccttctaaattacaaagcaattttaatatttgtaattttttgttgagctatgatgaactgtttttatggcaaataagtcatttagagaatgactagcaaacactcggatacatggaatttagcactcttttttttttttttttttttttatttaagatggagtctcgctctgtcacccaggctggagtgcagtggcgcagtcttggctcactgcaagctccaccttccgggttcacgccattctcctgcctcagcctctggagtagctgggactacaggcgcctgccaccacgcctggctaattttttgtatttttagtagagatggggtttcaccatgttatccaggatggtctccctgaccttatgatccgcctgccttggcctcccaaagtgctgggattacaggcgtgagccaccgcgcccggccagcattcttatatttaataataataagtggcaagtaggtaccttctcgtagaaataataatcacatttcttaacaggtattaaggacaaggatcattgttctcctgttcactgttgtattctcattgcccagcactacatttggcacatggtggatactttcacttggttggatgaattttcaacatttagagactttaaaaaaatcttatttcactaggatagggaattggccagttcaataatttttctatcagaccctgacacaactttttttttcttttaaaaatatatgtacctggctgggcgcagtggctcacgcctgtaatctcagcactttgggaggctaaggtgggtgaattgcttgagcccaggagttcaagactaacctgagcagcatggtgaaaccctgtctctacaaaataagaaaaaattagctgggccatggtagtgtgtgcctatagtcccagctacttgggaggctgagatgggaggatcacttgagcctggggaggtcaaggctgtagtgagttgtgattgcgccactgcactccagtgcgggtgacagagtaagaccttgtctgtctgtctctattttttatatacgtataatacgcacatgcgcgcatctatcttgtcttgagagatacatcttacatctttgattttgcttttgtgtttgctttggtttctaattacaaagtacatgttagtatagcctatgctttgcaaaataatttggcctgggaatgcttctttcttttacagtagaaattaattttgtgctatttagaagaatccagtatatcgcacaatattcattttatttagtattctctgcttctcagagatgatgcattctttatattcatcacctgtgattccttaggtgactgtatttacgaactacctttaaagtgtgcttagaaattatattgaaggaaagcagcaactttggttttgatgaaatgctcagagacgcagacagatacagcaaggatcacatgaccttttttattttcatcttgccgtctagatgacctgacctgttcattagaatttattagttctgtgcctctccagttcctttaaaagaaacaaaatgattttcttttataaataagttagcattttaggaggtgaatgtgtatcttacatatgatgacaaacttcagaaaagaaaaaattagccagatgtggtgagtacctatagtcctagctactcagaaagctgaggtagaaggatctcttgagccctgaagtttgaggctgcagtgagctatgatttgtgccactgcactccagcctgggtgacagagtaagccctgtctcaacgaaaataagattttaaaatttatgtatgtatgtatgtttgagacagagtctcgctttgtcacccaggctggagtgcagtggcatgatctcagcttgcttcagcctcccgagtagctgggactacaggtgtgcaccaacacacgaggctaatttttgtatttttagtagagacagggtttcgccatgttggccaggctggtctggaactcctcacctcaagtgacctgcccgccttggcctcccaaagtgctgggattacaggcgtgagccactgcgcctggctgaaaacaagattttaaaatctgagtatctttcagaaaaaaaataaagtggtggtatatgttatttgattattcaggatttaatttgtggattattcattcttgtttctcctattgcctcatttgttattttgctgttcacaaaacataaaattaatatttttctgttttagcttaagtaagctaggaaatacaatgttttgaactttgtatattaattaaatattagtaaccattgatgatgttttctagagagataaaattaccaagacaaattgagctgtttcttgtgtgatatctaacctactgggagaagtcattaggagtttgtcagtatgttatatttgagcatttaatattaattggatatgtttaatcttacctgctttttctttaggtggccaccgagtactaaattcacttgggaataaaagaaaaacataagaaaattataagagaaaggtacacataagactaagagctttagactttagcttcagcctgttttctccttccttgtttgcttttaggtcattttcttcatttaggaaatgcatccttgactttcaaaacatagacataataccctttctgtctgccatttttacatgtactttggtcaaaaatggcattcatttgttgttcgtatgaaattattggcatttaaattgatcgtaagttccttgagggagaggaatagatcagatctaacattttttcccccttctcttctcaacaaagtttgttattatcatgaagtggttatttatttaataagccaggctttggactgtatgtttccagggcaggaaaatctgttttaaagttatatcttaggttttttttattagctccttttaactgtatgtgcatgataccagcaaaaggttgtattttcaggcatctcatattatggtttaaagttctcatagggatttcaggaccagtaagagtcatatcctgtttctatttaggatgtattaatatatatataaagccaggcggagaatcacaagaaaatttaaaaacaattgttttataagcttctttttcccctatgtgttattactgtggggctgcgagtgttacaacaagtccatatctagattaagcagtcaaggtcaggcacggtggctcatgcctgtaatcccagcactttgggaggccgaggcaggtgggtcacctgaggtcaggagttcgagaccagcctggccaacatggcaaaaccccatctctactaaaaatacaaaaattagctggtcatggtggcccgcgcctgtaatctcagctactcgggaggctgaggtaggagaatcgcttgaacctgggaggcagaggttgcagtgagccgagatcgtgccactgcaccccagcctgggtgacagagtgagactgtgtctcaaaaaaaaaaaaaaaagaaagcagtcaaatgcaagggaatgaaatccttatttactaaaacacattagtaggcactggggaatttaacttttgagtatggatatcctttccgaatatttttggtgcatttgtaataaatgtcattttctcctttttaaaggaattgtcttagaagaaagaaggcaagccaccattttacccacgtaaatatatgaatatatttctgacattgaggtgttccagaagatgataaagaaatgatagcagctccagaaataccaactgattttaatctactacagtaagtaaattatattctgataatttttaaatacttgtttattccacaaaatggggaatgcattaacttcagttaaatttccttctgctcgagaagatctaatatataaaatagcttttatgctttgcaagagtttatatcagcactcatcaaggctctgtaataataattattctgtacttttttgttgttgtgttttaaatttgtcttttagtttacatgctgcagtttattattttttgttgtgtagttctgagtccatacttggttttgcaatagcaactgttttgagagagcatcataaaattcctaaaaataaagttttctcattagtgaggtataccatgtggcactatttaggatgtaatgtcagatttctgttacaaaatcaaatgatgattgcagaaataagttacatgtatattggtccagaaagtgttttcaacataggtatcctctttacccccatctgaaaagctaactgtactccttagcttttattctaattactccttggttttgaaagattttgaactactctatgtaacagtgattttcatactaaggtacagtttcatgagttgcctcagtgaaaagtgaacttttaaattgcccgtgaatccctttatttacccacccccaccactgtattttttattaggatctttatgagacttgacttgaaaagagagtttagttgctaaaaattttgaaaacaacagactaatacctttgtacataatggcagccagcatttacttttgatcatatgtagattttcatatttttaataattttgttatcttcagtggagtttatgaatcttctgggaccaaatacattcaggttcccacaaaacagcatttttagtgaggattttatgtattctaagtctcatatctttgtaaaagttaattattacctttgttaatattaagtgtctgctgtatacaggatgttacattagatcctgtgaggaattaagttaggtacttcctgctgcctttatgagttcatattttaaagatataaagagaagattatgaagtttcttatatacttggttagagactataaaaagggtttatattatggactagactattgactgttagaatatctcaaataatgaggacctgaaataggataatgaataaaagggaattgatgttgttcgggtggaacaggcccagcatttgactgggtatgtggggtgcagggcacagtaaagaggaatggaagattcagtcgtgtgatagatgactcaggatgtttcaggtcactgaatggttaatacagtatgtttaataaacataactgttatttcacctagggtagtttttgttgttcttttgatcttaaaaacacaggaaagcattgaagaacggcttaggagagtatttcttctttggttgggagtattttagacttccattctgattactcacttaagctttctttagaaagtttttcagtaagttaccaaacctctagtgcttcactcttagttgggatagcttggagatgagtattaagaggataattgagcccttgattactctggccattggaacattgtgaagactatagtgattttcttcagacttaaagcagttacttagctctttaagagagctggtgtcctacgaaacgcttgggaagaaataaatattacttatacatcaagatattttaaattttcattttttttttgcaagaccatatagacatgtgagaagattattgatgacaacaatcttcttaagatgtaacacacatgagcttcagggttaatattatagtagtcattcagtttttggtgcattaactctagggaatggtatttattacaggccctttcctctcaacattgtaggatatagttaggattgccaccaccttccatacattgtttaaattactttatatgtaagtgctgtataaatagtattttttttcctgctagcatcttaatcattattttagatttatgaaatattcttacctcacagcctctgctacctcatagcctctgggcaactggttattgtagcaataaaatggaaatagaagaaatctagattgagaatactagttttataaagatagcctttcacttcgattccatttattttaagcagagctggtgctaggtttacacatttagggtggaaaaacctttatcttttatggatgtggctcaattctaaaatccagtgtgacccaaatactaatataagtatgccttgctttaagcatttaaatgagggtatgttactactatttagatagactcatgtttactcatttggaaagcatcacacatatttatttaaatcggtcggcttccatatgtttgtgagaaaatccagattatacaaactagccttaccccaacccagaacaagggacagttgtttaggactatagattcatatgttggagattgtagagactttagagatttcgttctttcctgcgtatatattatttatagatgagaagattgagattgtcacttgtataagatccacagttacttagtaccaaaactgttctcctgactatagctcatcacctctttacttcataaaggatattgatcacttagcataattccctagtgtatttcaaatgctttagtttataaaaaggttttataagtaccctttcagaaatacatgttttgtatattgactcacctagatttataaatacttttcgagtgaggtaggagagatcagaggatccataatcataaaactccctaataaagttcctccaatgcctagtattaaaatacagtttttccgcagcactgtgatctttgaagtaggaaatggaaccaacgattacatggaacaccacagttcctagggttaaattttgagacccactggattagttttcatactttgattaaaaattaacaaaaatgtttaggtatttgtattttagattattatttttgtagctgcttatgtaatcttgtgtgtttggtaacgtgctatagtatgatgttttggggaaacatcttaattacttataatgctaatatgaagttttgtaatgagttaaccaagcctttcttttagaaaatatggcaaaaattagaaactcaatataaatttctaaggaagggttttaattcttatctttctgtcacagggagtcagaaacacatttttcttctgacacagattttgaagatatcgaaggaaaaaaccaaaagcaaggcaaaggcaaagtatgtatcaaatatttgactttattttgtttcctaagatctcacacacacacagatttaagttatgtctcagatagttttatcttttaaaaatggctttttaagggggtgggagctgattggtatggtaagccttctgagtaaatgtggtccttttgtcttctagaccaggtagcctttgggatctatttacactgctgtaaagttgcaaataataataataataataataataataataataataataatacatttccagtagtttatttcgtaaagcacagtatgtgaagcagaatgcaatgttctgttggctttatttttgttttcccacaagtaataaaatgtaaaggaaagcaatatataaaatctttaaagcactctaaaaatgtaacatacaaccagtttaaggctaatgggttacaaatgacaatagttttactctttataagtaatatgaaagataaaaaattacaaagttaagttctgagtcaatataatgtaagtttaaagtgtgagtgggttagcctgagggctggatataacttggcgaatggctaaattattttgttgttttggaaagtatatttgactctgcatgtgtgtaaatacattatgcaaaagataacttgtttttgttgttcagcatttgtttttcaaaatgaattttggatttatattgtctcatgacatactttgaaaaagtcttaacaatacagaagtttacgatgaccaaagtgaaatttttccataatcctatcacctggaggtaatttattctttaaacattttgatgcacatacttctattcatacacctatgtataaacatgatgataacattttatttaagtggagtcatactatgcaaacagtttaatgtgcttttaaaactcaatggtatgttgtcaacagctttcccataagtgactgtaaaactctcttttattttttttctattttttaaattaaatttatttgtttttttggagatggggtctctctatgttgcctagactggagtgcagtggctattcactggcacagtcatggcacactacagcctcaaactcttgggctaaagcaattatcctgcctcagcctctcgactggactacaggcaccacaggcctgtgccacgatgcctggcttctctgtaattccttttattttttatttttgtagagatgagatttcactatgttccccaggctggtcctgtactactgggctcaagcagtcctcctgcctcagcctcccaaagtgctgggatttacaggtgtgagccaccacgcctggccattctcttgtgatttctaattgtggcaaaacatcacgtttaatgtatggaacataatttatttaactaatgcttggaatattttttgagtgctcataattcatgtgtttcataattttgtgtgctctcttatttctttaaaaagactcgagagagggatatgaatagaaatattaacttacggctatccaaagataaccttaattctattggacagtataatttattagaaaaccattttttttccattaacctattttgcctttgatttaatttacaagtttggacaagattcttggtggcacctgagtagatgactctgaagtttttgtgccacagtttggttaaggttatatagctactactgtgggtgaggtgttgggacaggtcaaggatttattacaataatagcaactgcattttgagactatactatgtatgttccatgtgttgtgctaacaatttcacatgttaatctaatatttgaacaactgcgtagatgagaaaacaccattattttataggtaggaaactgaagtccagagaatcccagtggttaaaggatttgagttcaggtctgtgcccttaaccctctatactataccacttcctaaagtctttatgtagaagttttttttctctccaaggttgtacacaggttagcgtatttgctttttgtataatgcttcctttgttattatcactccttgcacatttttttttctagcacagcatacccattctgccattttaattgtcccaattagtttttcatactgacagggactattgaggcatttgatagataaactgcaaatatacagctccatgttaattaacattttatattttactagtctattctgttgtagttgatcttttctttcaaccttatctctgaaaatgcttttactggggacaaaagcctttcattgtgcaatcaggaattaatgaattaggttcacaaagactgaatctcatttacagaatatagcagtctcccttattctcagggatacattctaagacccccagtggatgcctgaaattgcggatagtacagaaccttgcatattgaattttttcaatatggtaaccaaaatggctagtaagtgactaatgagctgcgtggatatgctggacaaagggatgattcacgtcctgggtgggatacagcaggatgatgagtgattctatcatgctactcagaatggtgtgcaatttaaaacttttgaattgtttatttctagaatttcctactgaatatttttggactgcagcagaccaagggtaactgaaactgaataaagtaaaacccaggggaggactactgtattgcaaattaacaagtaatatgtttcagatgtttcaggtgttccccttcagggaaggggtttaaagtaactgttaagagttgagtcgttttggactcttggaggaagaagggaccctctaaggaataaagtacataaataccacaggctttcagtggaaagaaatttgtaggcatcgctatagatcagagatccgcaatctgtggcttgtttttgtactgtccaggagctctaagaatagtttatatatatatatatatatatatatatatttttttttttatagagatggggtctcgctctgttgaccaggcttgtcttgaactcctggccttaagcaatcttcccatctcaacctccgaaagtattggaattacaggtgggagccactgctcccggtcgttttaatatttatttatttatttatttttatttatatatatatatatatatatatatatatttatttatttatttatttttgagacggagtcttgctctgtcgcccaggctggagtgcagtggcgcagtcttggctcactgcaagctccgccttctgggttcacgccattctcctgcctcagcctcctgagtagctgggactgcaggtgcctgccaccacgcccagctaatttttttgtaattttagtagagatggggtttcaccgtgttagccaggatggtctcgatctcctgacctcgtgatccgcccaccttggcctcccaaagtgctgggattacaggcttgagccactgcgcccggcctatttattgctcgagacagagtttcgctctgtcacccaggctggagtgcagtggtgtgatctcggctcactgcagcctccacctcctgggttcaagcaattttcctgcctcagcctcccgagtagctgggactataggcgtatgccgccatgcctggctaattttttgtattttagtagagacagggcttcaccgtgttggccaggctggtctcgaacttctgagctcaggcaatccgcccacctcggcctcccaaagtgctaggattacaggcgtgagccaccacgctgggctgtttttataattttaaatagttttaaaaataaagaatgtgctacagagactgtatgtggcccacaaagcctaacatatttactatccagttctttacagaaagttggccaacacttgctttctagatcgtagagatgtgttggtctaaaagagacctttaagaaatcatcaaatccaggggtcggaatacctttctgtaaagtattttaattcaaccctggcatttgagaaatgaggattccgagttagggaatggcttgttttcttaaagtataagagctatgggaggtatttttatagcttaggcatatagggaaccttttcactgatttttttgatgcccctacccgcgcgtccccaccccccaccaatactgacaacttttgttataatgggcttcatttccatagttttcattaattgaattttcatgatgactaaatgttggagggaggcctagaacaagaatgagattgataaacctactcctaatgttcagaattccttgttcagagcactgcaatgatttctaagactaacaatacaaataaaatgttgaactgagtataaggtacatatttgataatgagtttggttattcttgctgcccacttcagtctgcatccaaaagctgcataagggagtaatataaaacttggagatagctaccttgatttactacacccttgagaattctctgattatacttgagagatatttttgcagtgtttttcaaactttgttgatattttgagggcttttaagtctgtgattttatattacttttcaaaatagattcaaatcagtattttgtgtcattgtttctgttggtcttcctaccagattaagattcatgtaacatttactgaactccttttaacataattttttcattttacagtgataacaatagctgacattttttgactttattatatgctgggtatgttgctaagtactttgtgttttcattatcgcagcaaccctatggggtaggcacagttttatcctcactttacaaattagaaaaacatcactgaaacatagtgtggttaagtaatttgcctaaaatcactcagctaatagtagcagaaatttgcacccacagagtctgtctgtctgcagaggctatgctgctaactactatgtcatgtgaggcatggtagtatacttgaaaaaatggacaccacaaagaggctgtcacagttatatcattttgttataagtggatggaattctttagggcaagtttaagcatgttatgtaccctatcagctacttctactgtagctgtgttttgaactctcaaggatagtgatataacttaaccacctcgtattttttatgcagacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcaggtaagatttatgttgttcttcccagttcatttgtacattttaaactttaatgagttatatagagtgtagctctgatttttctaattgcattttaaacatacactacttattagaaaaaagcaacaaaatcatcagaaaactcttgggatgtatttcttcatatataagacttttgtgctgtgttttgattcattttctgctgcatgcttttttcttttttcttatttattttattttattttatttttttttgagacagagtctcgctctgttgcccaggctggagtacagtggcatagtctcggctcaccacaacctccacctcctgggttcaagcgattctcctgcctcagcctcccaagtagctgggattacaggtacaaaccaccatgcctggctagtgttttttgtttgtttgtttgtttgttttttttgtttttttgtttttttgttttttttggtgggtattttcagtggagacggggtttcaccatgttggccaggcttgtctcaaactcctagcctcaagtaatctgccctccttggcctcccaaagtgctgggattacaggcggaagccaccatgcccagcccattatttattattattattattatttttttgagatggagtctcactctattgcccaggctggagtgcagtggcacgatctctgctcactgcaacctccgcctcctgggttcaggcgattctcctgcctcagcctcccgagtagctgggattacaggtgcccgccaccatggctggctaatttttggtttttagtagagatggggtttcaccatgttggccaggctggtctcaaactcctgaccttaagtaatccacctgcctcggcctcccaaagtgctgggattacaggcgtgagccaccacgcccagccccaacccattatttttttttaatggcctaaggtaaaaaataatttggtcaaaaatatgctgatgtaaaccatggctatgaggtctcaattttccctgaatttatatagatgccattaaaatacgaagtcttctacccatatggaattcctggttgagtgacctaatataattattatccactttagtggaatgaattattttagttactgttgtctattacaaattttattatttgtgcttgtttcttagaagaataaaaagttggaggcatattcatgtcgaatcattcgaattatgttttctctgcatacttttatgacaatagaagcatttaggctttctaatgttggctaaaccattagaaagtggaataaatacaatactcaaggagtatatatacttaataaagttttaatttaatttataaaagctacaggcaatagtttttttttttaatttcaacttttagatacagggattacatatacaggtttgtacatgagtatattgcacctaggaagtgagggtagtatccagtgggtagtttttcagtccccaccccctacccccagtagtccgcagtgtctatgttttccacatttgtgtccacatgtgctcaatatttagcttccacttacaagtgagaacatgtggtatttggttttctgttcctgcgttaattcacttaggattattgcctccaactctacccatgttgctgtgaaagacacaattgcattcttttttatgactgtggagaatagtatttcttcatagaaataactttaatcagtgatgggtgcacatgaatggttatctgagaactatccgttcaggctttttgttaataaaaactgacacaaataccttgtttagaaatatagaattagcttaatatgtgtggttttataaataaaatgtgtcaaatgaggctaataaagaacagttttacatgtaaaatgtgaaaatacttgttaattgtttgagctttcgccaattttacagagcaaagaacttaaaaggtgccagatttattcataccattctaatgcacctttttaaatccgtttattaatgtttgcttgtatatcatgattagagtgtggattctttttcttgtgtaatgttttaaattactgttttgaatatgtttggcttttaaaaaataaataatgtcttattatattgctgtactatggtttatttagtcattccccaattttaaaaattacttttctctctctagttctccttttgggttatttttatcaagaggataaattatttcagttacattgtattgcatttcattactttccttcttttttttgtattatacattttctctaatattttgttctaagtagttaaatgcactaatcttctttcttctgctatctttttaacatcagtgtcttagtccatttgggctgctattaaagaaactaacataggccaggtgtagcagctcacataatcccagcactttgggaggccaaggtaggtggatcgcctgaggtcaggagttggagaccagcctgcccaacatggtgaaacccagtctctactaaaaataaaaaagttagctgggcttggtggtgagcacctgtaatctcagctactcaggaggcttaggcaggagaatcacttgaaccctggaggcgtaggttgcagtgagctgagatcgcaccattgcactccagcctgggcaacaagagtgaaaccctgtctaaaaaaacaaacaaaaacaaaaaaccaacataaactagaaagcttataaaaaacagaaatttatttcttacagttttgcaggctgcgaagttcaatattaggtgcctacagattcattatctggtgaaggcctgttttctggttcatagatggcatcctcttactgtgtcctcacatggaaggggcaaggcagctctcaggggccttgtgatcttattgccatctataggctccacttcttaataccataacattgactacagttcaacatacagtttgaacacaaaacccttcagaccacagctatgagaaatcctgactcataaccacagctaattgggctattccatttttatctaaaaatgaatattttctttatttttgtgttgcttatggcttgtcatattaagattgtacctctatctgtgccatttttgttttcattttttattttaagatgaggtttcattatgttgctcaggctggacttgaactcctgggctcaagcaatcctcctgcctcagcctccccagtaagtgggactacaggcacatgccattgtgcctagcttgtttttctgttttgaaatgtgtttccctcttaagagagaatgtctgcactgtctttccattgatttcctggaatcttttcaacaattttattttgttatgtgtgttcccacttgtgttacccttttaagaccaaatttgatggaggaagtcctctgtttagaaacttccaagggttcttatctaaaatttctagctcagatttccttatgccatgttttctgtcctccagtcacagtatatactctgcccttagacttttctttttgtttttcttgttgtttgcaatagttttattttactccccccttgcatatcaaataggactgagcgaatcaaatgtcagtcttctgaaaagcattctcagacactactacttttcctttccaatgtgttttttactcttatcttttcattatatagcacttatactgtgcctgactttgactctagattgctaattctttgatcaaagatcatgtgttattcattatttttgcattgccaggatatacctatctcagtagttgttgttgttgttgttgttgttattattattattattattattattatcattattcgagacaagatctcactctgtcacccaggctggagtgcagtggcatgatctcggctcactgcaacctccgcctcccgggttcaagtgattctcatgcctcagcctcccaagtagctgggattacaggtgcatgccaccacgcccagctaatttttgtttgtaccttttggtagagacggagcttcatcatgttggccaggctgtctctctcagtaattataagtgatagtcaataaatgcaagaatggctgttggtttaaaactggttgttatgttttaagaatggagaaagtatgcgtgtgccccttaattttattatataacagatgttgaattttgttacataagttctcagcatactatttgattaaaaattttaagcatatttcagtagctcgcattatttttattatagcagacttattttcctagtgtaaactctacttgatcttaatgaattactttttaatgtgatgtagtggtctctttgtaagagttcattgaatattttgcatctttattgatgagagtagccattgttccagttatctattgatgcataacaaaccaccccaaacttagtgatgtgaaacaacaatcattttattatgcctaatgattctttgggtctggaattcagacagaactaagtggagatgacttgtgtctgctttatgatgtcaagggccttagcttggaccatttgagtgcctggcactaacacagttagggactataatcatttggaagcttctttactcatgtttagtgcctagtctgtagtgatatgaaggctggacttagccagaactgttagctgcataactacaaatggcctttctatgtggctacggcttcttacagtatggcgtctgggtttggagagaatgtcctgagagaagtgtccagtttgctagtgctccaagagaccagtgcagttgctgcctggcattctgtgacctaattttggaagcatcactgcattctattctagagaagatgacatagaccctcttactggggagcaatgtccaataatttggggccatgttttaaaactgtcacagtctctatgatatattcttttgctgtttattgcctatatcatatttgggaaaaatactgagcacatttcttttgtaaattatgttggttaatataaacaagctgttgtaaatacaacaaagtagaaattaagtaaagttttagaataattccagtcagtctatctgaaccaggtatttcttagatatttttccttgatttatctttattgtgtaatcatagtatcttttttgtacattagattctacatgttttagtcattgtttgtacctggatttcctatttattggtatataacttagaaacatttccctctcccaaccttttgttttttatactagctcttgtttatcatcttgattttatttaatttgctctatttaaaaagttttgttgttgttgtttttgtttgtttgtttgtttggagacagagtcttgctctcttgcccaggcgggagtgcagtggtgcgacctcagctcactgcagccttcatctcccgggttcaagtgattcttctgcctcagcctcccgagtagctgggattataggcatgcaccaccacacccagctaatttttgtatttttagtagagacggggtttcaccatgttggcctctcgaactcctgacctcaagtgatccgctggcttcagcctcccaaagtgctgggattacaggcgtgagctaccgcacccagcctaaaaattgaaaatcagttttgtcgttgcctctcttgccccgaaaggaataaagtattccttttatttttagttctagcctattttcttttttaagaaataaccatattgagatatatttaccatactataaaatttaccctttaaagtgcaaattcagagttgtacagccaccattacaatataattttagaatattttatttatttttattattttttttgagatggagtctcactcactctgttgtccaggttggggtacagtggcatgatcttggctcactgcaacctccatctcctggattcaagtgatactcctgcctcagcctcgcgagtagttgggattacaggcgtgcaccaccacgcctggctaatttttgtattggtagtagagacaaggttttaccatgtcagccaggctggtctcgaactcctaacttcaagtgatccactcacctcggcctcccaaagttctgggattatagacatgagccagcacacctgccctgtattgtcttaattatttgaaattctctcctttctttaatgtcactgagaaatcataagtaattatacttgatggaattgacttccatagtttccacattcttttcaatgcaaaataaatagaagattgataggtcattttgtgttatcagataattgttttactgaattcgattctattttattattgttaaaattgaactttaaatttcagtgtataagtatttatattaaagtaatgtgatactatataatcttgaattttatgactttatcagacttaattgattttgagaaaattagaagaagctaatgattttatttttttccctctgctgtagtcggtggtagatgattggatagaatcatacaagcatgaccgagatatagcacttcttgaccttatcaacttttttattcagtgttcaggctgtaaaggtaagatatatttattttgaaatcagcagctctcaaatagtcacttcgttgttccacctaaagagatgttgttagcactttacatggtaaataacgctaaggcattatttgcatcatatccatataaaatttgtaaggaaaaaagagcaaaggacaaagtaagagagaaagtctattgacaaagttttattcatatgtgaaagttatctaaaaacttagcagtttataattattatgttacttttattagatatatttcccactttcagcatctggttttaggaacaaagaaattgattaagaagggaggaggaagataatgaagagatacaggttcagatgacaggtaatcgtacagtgtagggagttaaaaagtgccatgaataacagtaagtaagcaagcaagcaagtaagtaagttacgttaagtaagttaaataaggtattgataaaatcgacatttcttctaaaaggtaaagaaattttgttgtgtgtagtggtgtctttaaagtgttttcactttattttaaaaatattttgaactgggaaagatgaaagtacaaaatacagaaatttcttccctaagacagaagtatttaggacaaacatttggcagggggacaaaattatgtaagttggggagtcatatatcctcatatggatcaataaatgagccagtcaagattacgggcaggttctgatgtatctggtgtctcccaatacttagctcatccttgaaatttcagatgatgcccgggcaaatacattttatggagatttctgggggtattttttttttttaatgaaagtggcatcaacaacattagagcattagaaattgggagaggaagttgcttaaaaatagatataaaacgttaagatggtaaagaatgatttatttaaacaaatgcagaaactgaattgtaagaagcaattcaattctgcagtattcctttaaagataccgtaatatctttgaaaaacaagtaacattggtagagtttgatcacaacattcagtgtagtatgtgtattaaatgttacctgtctgtgaggcctgaaagatagacaactatattaaattcttgagcctgtgatctttataatgtcactaaggtgttgagaaatttaaaaaattgtcttaatcatagcatatagaaagctgcctagtttacttcatttgcctaaaataaaagtagctttaattcaatattagaaaattcagctgacttctgctcagaggagatgttgtcatgatgttactatggtatccttaaggttctgaaccagattgactgtttaaagatgagctatactaaaattatttttccctatatccagtcatttttttctggggtaggatggatataagtacctgcttgttgtgtcatataatcaagggctatgtcctttctcattaggctctttgcaaatggaaggttgagtgcagacagctgaacagatgccagaaataacgtaatgagttgaaattttaaatcttaagtctccccttttatttattattattattattattattattattattttatgagagagagtcttgttctttcatccaggctggagtgtagtgtcgtgatcatggctcactgcggccttgacctcctgggctcaggtgatcctcccaccttaacctcctgaatagctgggactacaggctcacgacaacacgcccagctaattttttgtttctgtttttattttttgtggacatggggttttgccatgttgcccaggccgcaagtgatcctcttgcctcatcctccgaagtagctggggctacaggcgtgcaccaccatgcccagctagtttttatttttcgtagagacagatctggctgtgttgcccaggctgatcctcaatctcctaaactcaggcagttgtcccacctcagcctccaaagtgctgggattacaggcatgagccaccttcctggcatgagtgagtttgtttgtttgtttgtttgtttgtctgtttttggcatgagtttctttctttctttttttttttttttaatttaatttttttttgtagagacaggtctttctctgttgcccaggctggtctcaatctcctagcctgaagaagttgtcccaccttggcctcccaaagtgctggaattacaggtgtgagccacccctcccgcctgagtttcttaattaggcttctgagttgtagttttttttaaaacaaggccgcagagcatgttccctttgtcaaattcattccttttttggcatcagtttgtttacaaatcaggagcttgctaactcaacatttggaccttgtcacaagtgagtttgtcaagatttctaaaaacttaaggtgttgaaaacttaaattgtaaggttaatttaagcactgctgtaatatttatcttagaatcaggcaatctccatgaaggggaatttactatataatcaaagataaagccattaattacttatacacacaaaattattttaatataattcttttataaatgacttagaaacttctttaagtatacttattgtaatttaacatttcctgcagacccaaagttgttataagcatcagttattttttctacaatacattgatggcttctgtagctgttgaagcatggagggatatttaactccatgctgctcctgactgctccgttggtgattctgtggccagtgttttcttctttttttcctagtcagctgtcacttttctttttttctttctcttttcttttaaaatagagatagggtcttgctctatcacttttagatttaccggattttagcagtcttgctaaaaatgtcccccacatttttaaggcagcaggctctggccttatgtcctaatggtggcttcatacctgcctcaagagttaaatgaatggagtttgtgatagctactttcttttctgctctgaggtccttttctgcttgtttttgggtttctggatgtcttgtggtttatgagacggggaggagctttagaaatgagggattgttgaaaagtatgcagtatgtttgctttgagatatatttatatgtaaatgttaatttcacagaaatgttcaggtcattagttactttttgttctctagcattcccaggtatacagcacctgggtatgaagtatgggaagattttgaagagagatacgtgattctagattaaaaacaaaagcctttcaaaaggtttttgagagtgttttctcttctcctcttctctcttttttttttttttttttttgtgagacagagtctcactctgttgcccaggctctggagtgcagtggtgtgatctcggctcactgcaacctctgcctcccagattcaagcgtttctcctacctcagcctcccaagtagctgcgattacaggcatgcccagctaatttttgtatttttagtagtgacggggtttcaccatattggccaggctggtcttgaactccagacctcaagtgactcgcccgcctcagcctcccaaagtgctaggattacaggcatgagccaccgcacccggccaagagtgtgtttctttagccagagaaatggtgctttctcctgagttcatcaactttttaaaacaatcatttttttttttttttaagttgcggtaagtaaggattcttctagggtacgactagaaattaatctcacccagataagagggaggcagcatgatttaggtgaatagtctcagacaaattatttaatttcttttagccttagcctaagccttagtttcctcatctttgaagctgggattatggatttacagctatgtatatacacaggcgcgcgcacacacacagatgcatgcatatacaaaatattgctctggtcaattgaaaaaaatctatgttaattatatctagttcttatttataaatctcatcttcttgtaccaagacattcttcttttagatattactatatttatggtatttctagtgagaagactagtaagcaaataattcaacaataaaaacaggattttgaaaatctagtatttacgttgattacccctgcccccatctctctctttctcagtctgatgccccatcagtggaagttcatgtatctcttcttactgcacactagaaatttcctttctgatgtttggtctccacctgactaatgttttactacttctaatgtgtaccttttcttttttcctctcccatcctcctgtgtaagattctaaaggtccttatcaaattgtttctctttgacatagttctttattttctaacttataacatgtgtggtttttctggtgggtatggagtggaggtggagtcagagctatagcatttggcatttccacacatcagggctttgattatgtactacttttgacagcttctttttctttttggtattctttagttttaacttttaactagattacaggcgtctaggtgggcaggaactacaatttactacttagctcttttagaggatattaggatgtagttactttacatgcaatagtgcttaataaagagacttgactaaagtgaactctagctattactcttttccttatcttcagcttcatccccaaggttttaagtgttatactagatgctatctcactcttgataacatatggtttatgttaaagagacaaagccaatataaatattacagcatgagtaaagtgagtcaggtagaaatggccaaagttaattgtgttaggaaaaaagatatctgtcagaagtatggggctgttttcttgtgcatactgagaatagatagcatttgtttgtgctttatttatagattagagtatcatggtaaagattattagatgatggttgaagaagtatgccttttattgtgtgaccatagacttcttagtgttagagacttacttggaagttttctttatttttttatcacaccatatattaacttctgacatttgcaaatttcaggagttgtcacagcagaaatgtttagacatatgcagaactctgagataattcgaaaaatgactgaagaattcgatgaggtaacttactaccttaagtgttttgataacttatgcatgtttatcttgacttatttttgaaagtattattaaattgtaagcattaggctgggcatggtggctcatgcctgtaatcccacactttcagaggccgaggcaggcggatcacctgaggtcaggagttcgagaccagcttgaccaatatggtgaaaccctgtctctgctaaaaatacaaaaaaaattagccgggagtcgtggtgtgtgcctgtagtcccagctacttgggaggctgagataggagaattgcttgaacctgggaggcggaggttgcagtgagccgagctctcgccactgtactccagcctgggcaacagagtgagactccatcaaaaaaaaaggaaaaaaaaaattgtaagcattaatgttgtaaataagagctttggcattagatttaatcaaatgatgcctgtgcgacctttggcaggttgttgtcttagtgtcagttgtttttttttttcttttttcctgagacaaagtctcactctgtcgcccaggctggagtgcagtggcatgatctcactgcaacctctgcctcctgggttcaagcaattctcctgccacagccttccaagtagctgggattacaggcacccaccaccacacctgaataatttctgtatttttagtagagacatggtggggggtggtgggcggtgtgggtttaccatgttggccaggctggtctcgaactcattacctcaagtgacccgcccaccttggcctcccaaagtgcggggattacagcaggtaggcgccactgcatctggccagtatcaatttcattatctgtaaaatgggcctaatagtactttactcataaggctgttacgaagattgaattgagtaatgtttgaaaattgcttaacattttatggttcccagaacatagcaaggacttaataaatggtagttattattgacaaaaatgaaaatgtcaaggaaaagtataagaacatatcctggaatgttgtaaaaggaaggtttcagcaatatttagggaacctgatagctagggcaaaggagtatatagatacttttattgtttaaaaactcttaagaacaacaaagattacatattagtttagactgagttgtcccccccttacctccctagggctagattgagttgattatttcattgagctctttgaagtattgttaccaataaatacatacatagatttactataaattaagcttcttcaaggaagggatttgggtttgtttgggtcacggctgtatttcagcaccagtacttttactcttccaaaatttttcgctgtgggttttcaagtagaaaatgttgtctgatttgagttttatttggtcttttttttcttgcttactctgatgaaggagctttgaactattattctaaaagatagatgagttaaaatggctttgatgatcgctaagtgctattaatcactccccaagtagttgagaagtaattttgaatagtggcattttttacccttttaatattgaatgttttagtgagaactttctcactaaaagggaacaactatttgagataattgtcctgaaatatgatttgaaaatgtcagcaaaccaagttgctaacaattaagatgctatatttcaatatagtcactaaattagccaatcagaaaataccaaaaaaactttttttgtggaatatcaggaccttattctcagatgagacgcaactgcacttacatgtgacatgacttcagattttaaaaaatgttctgttgacaaaaattaatttttaaaatttactgaactgaattaccttacatctctaggatactcttgtcagagaccgttacttttagatgttctatatggtattggtctctgcttttatttctaagtacttcattgtttttaatgatttgtggagaatctcagtttaccctgagactagagaatgccctcttgttgtgcaaaggaaaaccagagtaccagtcttccaaggcaatactagctacatttccatttctttaaaaaattatgattgtttatatctgttgactgtgtgatgtatttgaagctaataacatatttctaatgttttgttgatttatacatcatacattttatttgagagtataatttccatcattttgaatccatttaaaaatataattttggtttggtttgggtttgcttttgctttatatctgtgcttatcacaaggatgttttgttttgatgagggaggcttttaaaatttttaacctgagtaattggtatatattttcattgattaaagtgaattcagaatatctatcttgatcttaaataaagagctgaagtgttcagaggtacccctacctttatatattgttctcttgcctactttgaggatttattggagaagaaaggtgagataaagataccttttcatgcttttgtctagggtatttcaaaagcaagtgatatgttaagtcatgcattctaaatgaaattgctgttttaaatttttgttttaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcaggtcggtatttagaaatattttctgcatattgtcttagatttgagatgaaaaagattctcatttaaagagaaaggaaataacagagatacaaattaattttatttataaagtgaccactaagaggacactcccccatccctcctgcgaattcctggaaatgggatgataatttcagttttgattttgtgaaggtatactataactagtatttggtaattttcttgtatactatgcatactgtgccacagcaggggagaattggacaataggtatgtgttgggttcttgaaaaatactatgccacagcaagggaaaattggactataggtatgcattggattattgaaaaataccatgccacaagaagggaaaattggatgataggtatgtattgggtttttgaaagatatgttaccagggaagatattgacagcagatttggagatatcatcacagtcattttggatatgtgatcctgatgccatttagtttgtctttggtgtgcgttgcctctccaggtaggatggcccctactagatgatgcctgttctttcagtcacactgcaaaaaattgatttttcttatgtttctgggtaactttaggctggggcaaattctttgatctttaaagtttaatgaaataaggtatatttttatacctcataacatctgttagttcctcttttgtgcttaaggtaaaattggtgatacactgctgttgaatttgttgcttttgagtttcaataaataaaataggcattaattgttatgatagtattctgaatcttctgaatcttaatgatattttgatttttaactaaaaaaactttatattctctgttggtttgttttttatttataagattttctcaaagaattaaatctatgattaaagatatgcttctacgtccttcattattaaagagaaaatgcagtttcccgtatgttgtttttgtttttagatttgaagtcagaaaatatgaatgtgatcttgctttatgcacttgtggtagcaatgtcaataacttgatggctaaagtaaattaaaacagggattatggtgcaagatggatacttttagatcagagtgacagactggtttgctgggagcatgaaattaacttagagcagaaaattgggaaatctttctttaagagagccaatagccacaaatttaagatgtagttttattgttgttgtatcatgcaatgcaccaagtctgagaagtagtctggagtaagctaaagaaagcaaaaagtgatcagatctttcagttaataaattttaaatcccaggcaataagaatcttgtatcaggagtaagagtttagtaacagaaggtagagatctggaggaagttttatgaaaaagcactttaattaagtcacattttgccctttgttcttttgactttccatggagatctgttcacagtttcatcagtcatgttatagagtaaaatgaaaggaaagcaaatactgataaaattcctcaacattttcataaaatataatttgatgtaaagccatcaagttccttttaattactgaatagctaaataacttctgtgtgaactaaaatttactttagaaggtgaatcatgatctatgaaaatgattattttagaggacatattatagaataatgggatttaaggatagactggagtcagattgccttggtttgaatcctggtttgactgcttatatgaactgaggcaaattttaaaatttccctgagcttcaattttgccgtgaatgaaatgggtataatacttacctttgagagggccattgtgaggattaggagataattcctgaaaagttattttattttatgttattttattgtcatttgtagcagctgcatctttcttttgttagaagcagattagctcatttctgcttaatatttctatttgatcttaaattgtaaatttttgtgtctgttagattagtttcaccatacttttactctttaaaaatagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagaggtaaacttttatattgaatatttaggctattgtgtgaccaacttggtcaccattaattaggatataactttgctagtggctcagataattgtttttgaaatatttaaatgtaaataacatttcaaactatttgcccaacaaaattctgatgaatatccgtgccaacaatactgttttcttattttcaacctgcgtggactagtattaagagtggctttaagtaaggggactggggttagtctgacaagttgtcttaagctttagtattattcatctctacggtgaaaaaccttttgtcaggatgaaaagagatttcacaattaaaatcactttggaaaataaaatcactttgaaaaataacataagctgtttattggcatctaaatcagtgttttttatacagtagaaggcatttgtttaacattaatgactgaccaccaaattcaactctgaatgaggaaaataattttttcagccttatgcgaaataacagtaaataaaatcttttgatgctgcggctgtaatttaaattctttcttcattggtgataaaatattttgctatctcataatggagatgtttgttttcatatcaaataggcaaagtctgatttttcaaaaatattagtaatgcagttgaattcagtagttatcatggttatctacgaattattgacctgatcttgaatttttttggggaggggaattagtagctaattttaaattggttatttctgaaatagttaataactttaaaacatatccagactcaagaattgactaagaaaaatcctgatcatatttcacccatgtctaaattcctcatatttttcatataatttgaaataaagtgttgatactttttccctttaatttatgtatatgctatatagtaagtgatatgtagtagcaaactacattacagatttctttacagtgttttttttggaggcagaatctcactctgtctcccaggctggagtacagtggcactatctcagctgactgcaacctctgcctcccaggttcaagctcctgcctcagcctcctcagtagctggaattataggcttgtgccaccatgcctggctaatttttgtatttttagtagagtcggggttttgccatgttggccaggctggtctcgaactcctgacctcaagtgatccgtctgtcttggcctccccgagtgctgagattacaggcatgagccactgcacccggccttctttacagttctttagtggaaatttatgagcattagaaaaaaaatctactagctaaatattaaaatcccaatcaaatatttcaggtattaagggactttatctacctggtaatataactgttaatttttctatatggttactgttgtctagtataattcaaaattccccaaaatactggggaattctgctttttttgtgcttgtaacaacttacaggtgttcatttggttgtcttcctttacaattgaaaagaaatgatgtgtttttttacagcttcaggaaaatcaagatgaaatagaaaatatgatgaatgcaatatttaaaggagtgtttgtacatagataccggtaagttgtgacagtttttttcataaatagcattatgtaatttctactcagcaagtttgcatatttcgtggtgtagggaatctaaattagcaggaagaatgttatagtaaaatcaatgttagactccattagtgccactgagtcactctgggcaagttatttaactcatgtgagtttggtgtttcccatctgaaaaatgggataatgctgtgcttgacttgcagccagtagaagttactgctatttggagttgggctacacaatacttaattgcctttggatgcactatgttagtagagcctgcacgtgctgactcctgactctcttcccttccattgaatatcagtgggaacaattggataggttaaagtgagatattttcttttgctgttttgaatgaacagaggaaagaaatagtaatcttataaatttatgctgtaacctattcttaaattttggtagtatttttattcagcttccacatatcctcaacttggcagttactgaatcaggttaatgcttactttttgtaatgtctccatgtccattcttaccttttcacttctattgtcaccattaccttagtctgtttcctcattctcatgcctagagattattgcagttttgccaaaatatccttttattgtgttattcctctgccttcaatgactcaccagtacttacaagatgaatttaaaatcatttattctaacattcaaatcccagttgagcttgacctcagtgtaatgtataaataatacttacctggaaattacgctctagccagacaagtgtgcctgctgtcttctgaacacaccatgcccagcaggtgtgagcaaaggctgggatatggtatggtataaaaggtggggatgggattttgtttgtagttttatataattttaaatgtttatgtgttgataattatgctttgccacctaagcttttggcattcaggcccatgcttcatttctattttttaatccctagtaataagataatgtcatattcatagtagatctgaagtacttggcatctcttgaataaaccataagttttgtggtatattggcactaattatgcatcgtttttccttcccccattcagtgatgcgatagctgaaattcgagctatttgcattgaagagattggcatttggatgaagatgtatagtgatgcctttcttaatgacagttatttaaaatatgttggttggactatgcatgataaggtaagatgtgcccttcagactgcttctttctacacatcggcgtggctgtctgcacctctcattcatgagttatctcccagtatgtatacctggtgacacatttctggaagcctcccctttattcttttctatcttctctgtaaaaacttattttctatcacataaagtctgctagatatttttgaatcctggccactgatttaaccattaatggtgaatcatttttttgctgaaatattacagtcatgaaggtagtaggagtgaggcatttcttagggcacgaagaagaaccattacgctgttgttatctgagagctatatacttaaaaaaaaaattattcaattttgatcctctcttttgacaaacctgtatcttagccagattataccttactacttggtttctgacctttttaatatgttttcattaaactaccattctcttaggctgcctcttcacttgccttgaagaaattgattgtatataattctttccaaacattacttcccatagtggaaaatatactgtgacacatgcttctattgtttttcacaatagatttgttctgaacaaattttcaaaaattatcctttgaactacagaaatagtaaccccataggtatttagtcataaatgtatgtactgattactatttttgcattatcaaacatgatagtttctgaaggaatgctatggtatgaaacatttaaaattttaaagtagaaaatattgtgtacatcttgaatattgaagttgaaaatacatagagttttaatgcattgtctcatctttttttttttttttttttagcaaggtgaagtaagactcaaatgtcttactgctctacaagggctttattataacaaagagcttaattccaaactggaactttttaccagtcggttcaaggttagtattacttaagaatttacaaataacttgtcatttgcaaacacttttctcttgctttccttttaaaaatattttaatttttttgtccttaggatagaattgtgtctatgacccttgacaaagaatatgatgttgcagtacaagcaataaaattactcactcttgttttacagtaagtatgtatttgttgcatatttgcactaatgttcagatatctaaataatatattagagtatttggttcagactcatctaggtctaaattttagtagcttacgtcatggaggtttacagctagaagttgaatttcttcatgtatagttgagaaaacacaggaagaaggaaccatagaatatggaaattcttttttttttcttttttttttctgagacggagtctcactctgtcccccaggctggagtgcagtggtacgatctcagctcactgcaagctccacctcccaggttcacgccattctcctgcctcagcctcccgagtagctgggactacaggcgcccgccacgacgcctggcttattttttgtatttttagtagagacggggtttcactgtgttagccaggatggtctcgatctcctgacctcgtgatccgcccgccttggcctcccaaggtgctgggattacaggcgtgagccactgcgcctgaccgaatatggaaattctaactgagctaggaattcatgtgttcccattctcttggcagattgatttccttcctgtttttctgtttttgatgctcttgaaataagcacatcagtgtattaaaaaacatgcttattgtattttgttacacttttagagtatgagcatttataagaatgtctgttatacttctcatagcacctttaaacaatctgaatttaagacctattctgtgttaatatctgatagtgatgttattcatatttttcctttttaaaaaatggtagtaaaatatagattatgtaaaattcaccattttaaccattttaaagtatggtttactgtcattacctatatttacgttgttgtacaactgccaccactatccattgtcagaaccttttcatcactttattctggagctctgtacccattaaacactgattcttcattgtcccctttccccagatcctggtaaccactgttttattttctatctctatgaacttgcctattctagatatttcgtataagtggaatcatacaatatttgttttttgcatctggcttatttcacttggcataatttcttcaagtttcatacattattatagcacgtactcctgtttatagctgaatatttcactatatgtatattccacattttatttatccatttttgcattgatggacatttggactgtttccaaatgttattgtcagttattgtcagtaatgctgctatgaacatagatgtgtacaagtatctgtttgagtctctgctttcagttcttttatgtatacccagaagtggaattgctggatcatatggtaattctgtttaatttttttttgaggaactgccataatgctttttacaaaggttgcactgtttcacattcccaccagcaatgtacaagatttccaatttcttttttttttttttttcctgagatggagtctcactctgtcgcccaggctggagtgcagtggcatgatctcggctcaccgcaacctccacctcccgggttcaagcgattcccctgcctcagcttcccaaatagctgggattacaggtgcctgccaccacgcctgggtaatttttgtatttttagtagagacgaagtttcaccatgttggccaggctggtctcgaactcctgacctcaggtgatccacctgccttggcctcccaaagtgctgggattacaggcatgagctaccacacccagccaagatttccaatttctgtacgtcctcaccaacacttgttttctgcatttcaggataaatatttatcaagtgatgtctctataccaagcacttgggtggtatgttgagagagttaaaaatcagagccttctcatttcaaaataatatgacgttttataaaaatacctagaaataagaaatccaccagatatatgcaaagaaacattaataaaatgcaactaagggacataaaagaaggcttgaatttggaaagcttacctaggaaaactcagtatttaaaggcttgtaatcttcccattctgtatatttaccacaatgtaaatagtaaaggcaaaggaattttttttttttggccatagcaagcaaattgtgacatttcatatggaaaatttatcatgtaagagttgccagaagaatatgatacaaactaatgagtgaggactagcccaatgtatttttaagtcatgtattataaaatcatagtaatttaaaaattttggtcctggtacatgaatagacaaaaaagatcaatgaagcagaataaaaatagagatgaacacatatgcaccactaaaatgaccatgtaaggctttcatgagcatgacacaaaagctagatataaaaggatcaatgaattaactatataaaaacctaaaaatgtctgtatggcataaaataccataaactgagaaaacagatctcagattgggcaagatatttttgcatcaaaggagttaatttctgcaaatcaattaaagaaatctgtaataataggaaaacagtcaaatattataaatcagattattgacagaaaagtatgaatttaaacatatgaaaagatgttgggccacacttacaaacatatatattaaagtgagacttttaaatctgtttgcttggcaaagatagaaagtgtttggtaattacactatattgttgaggctatgacgtaacaggcccttttacattgttgatgggagtataaattggtctaagctccttggagaaaaacttgacagtatctgtcagaatttcaaatgctcatgttctctaacaaagcattgtttgtaatagcagaattttgaaaacaaccaagggtgcatatcactagaggaagaattaaattagtatgtaagataatagctaatataagcactttatatggataatttcatttaatactgcagctcagtgagatggtagtggctattcccatttctgtgaatcggacaacattgcagtaattaaaaagaaggcagttctacagatattgacaattcagggaactcacttaccttggaatttcttgagcagtctgttaactgttgcattctttaatttttaattatattttaaaatcataaatgttatacacacatgttgtatataaaaattttgaaagaattctgaaataaagtaacagtatgctacatatatttctatagcttctttcccaccatcctccacagtacactagaaacatcttctttctgatatttttatcaaaggtaatagacatacccattcatgttgattttcagccatctatatacctaataatttaaatttcttagaaacgttccttttcaaaaagttaaaatgagtgaacttctgtagagttacagtactttaacttgtttgattcagtgttttttttgttttgttttttagagacagggtcttgctttgtcacccaggtggtatgatcatggctcactccagcctcgccctcccaggctcaatccatcttcccacctcagcctcctaagtagctgggactatagctactgtagtcccaccatgtccggctaattttttttttctttccgttttttgtagagatgaggtctcatgttgcccagcctagtctcgaacacctgggctcaagtgatccacccacttcagcctcccaaagtgctgggattacaggtgtgagtgaccacacccagcctgattcagtgttattttgttaaaaacacacaagttatttttccaagaacaatctgatattatataaagagcaattgaaatcagtgtgcttttgaaacttgaattttaacaatttagttctttttctctcaaaaagaagtaatacttcttagacatcagacttctggaagctttcagcacaacagaaaaccaaaaagtaaagaggatctgtgtgcttcaactatccagtattcttaggcttttttcctctggcagtggtcctatgatttgaatttacatataatggtaaaaacctagattatatatatcacagtagactagaagcatattgggagagaaagagctgccaggggccaggactctgaatgcagttgcaagggaagaatgcaacagcgtttaccctggggtactgtggttgatgggccttaatgatgatgatttatcgaaaatattttgttaggcttattttgttctttaaagataagaaaaataaaatgagcattacattttagtaagatttttttccccagtgattgcagttaaagatctttggcacttagattttagttatttgggaaaaccacttgcattgccttacatggtgttcagtacatggtggatgaagcatttttgattgatgtgatataaatgggccattagtatattttgatgtaatgttgtgacttaatattactatgaaatataaggaaagtattatattatctgtgatttttaactctaagctcttagcttgctgcccctttactttctatatgggttttcattattttgtcttccttttctgttagcatccatgtgacataattcttttaaacgtttatttgtttaccttctgcattcacttttaattttacctgccatttatctttgatagattttggtagatggtaattaaataagcttgatttggttttttttttcctttaacacaaattcatgaaactttacaactttttaaaagtatgagcataagtttttgtactgttaatatgcttagaattaggacgttactaaaagcacctgttactgcttatttcttaggagtagtgaagaagttctcactgcagaagattgtgaaaatgtctatcatctggtttattcagctcaccggccagtagcagtagcagctggagaatttctctacaaaaagtaaatctatatatctgttactcattttctaaggcatactttcataacagtaatttgttatgttatacttgacattaagattatatatatataacttattttaaaaattactacagatcatatcgaagctttcacattttactttttcctttaaaagtttagatttctcctaagttctttgatttattttaagttagatctttaaagggaaatgtaggctgggcgcagtggctcatgcctgtaatctcagcactttgggaggccgaggcgggtggatcacgaggtcaggagatcgagaccatcctggctaacacggtgaaaccccgtctctactaaaaatacaaaaaatcagccgggcctggtggcgggcgcctgtagtcccagctactcgggaggctgaggcaggagaatggcgtgaactcgggaggcggagcttgcactgagccgagattgggccactgcactccagcctgggcgacagagcgagactccatctaaaaaaaaaaaaaaaaaaaaaaagggaaatgtacccatgtctttcagtaaacatgcttagaaagatacctaactatattataatattaagactgatctcttcctaattgtttacccttttattacctgcttcagcatctaaatattgcttatgctataattaggcttttttttttttgagacagagcctctctctgttgcccaggctggagtgtgcagtggtgcgatctcagctcactgtaaccaacctctgcctcctgggttcaggtgcttctcatggctcaccctcctgagtagctgggactacaggctgtatttagtcttcaacttatttttcctttcctttagaaaatattaaaaggttcttcaagtatttaataaagtttgacataagaatcccaagaattctacagtctctttacttttgtgatcctatttaactcagattaggtagtatgagtagaagtgtgaatatctgttcacagaaaacaaagattgttatataatggctttcaaagagactcttttgagccatatagattaaacttttcttgttcctatgatgttattaaaatgcctgttgggggtgcagcaattattaggaagagtaggtggtataaaacatttacactacagttttctattcattgctgtttagtgttaattctctttgttgtttatgaggaaaaatgctcatgctatccatagtaaaaggacagtaagttggggtaattttgccagaaggatggaaggaaagtatatgtttagttttcaagatgaatatgtatcatagattttttagcataaatggtgtagctttgtcaatgtactacttttatggaaggcaacagttatataaaatacagtaaggtttttaaaaacaaatagtttataactcagtacaattaacttgagaaattagtttaaaaggacttagaattaccatcaaacatgaaatgaaaaaggtttatagcaattatttgcgtggtgtgccatgttggatgatattgtacctacccagttctcctttactcctttgttagatccttagatatgaaattgaaacagttaatttttttattagaaaattttttgttgttgttgtcgtaaaataaatattttacttttttcacaggctcttcagtcgtagagatccagaggaggatggaatgatgaaaagaagaggaagacaaggtccaaatgccaaccttgttaagacattggtttttttctttctagaaagtgaggttagttgatagtatttattttatacttaggttcgaaaaattttggaaaaggggttaaaatgaggcacatttaaaaaaatattccttgtagcacagtaaattgtgaatagaatggagagccacccactcccccactcccccaatttttttttttaaatatgctttctacttttcttctttttttttttttttttttttgagacggagtcttgctctgtcacccaggctggaatacagtggcgccatcttggctcactgcagcctctgcctcccaggttcaagcagttctcctgcctcagcctcccgagtagctgggcttccaggcgtgtgccaccacgcccagctaatttttagtacagacggggtttcaccatgttgaccaggctggtcttaaactcctgacctcaggtgatccgcctgccttggcctcccaaagtgttgggatttacaggcatgagccactgcgcccggtcactttcttcttctagtaagatgttcaaacagtaggatttatgtatagtgctgagaatattaattttaaagttcaaaatcctaattgtcagttgggctactctgcttactatttgtgtgaccttggtttagctacttattctttcaaagcctcagtttcctagtaaaaagatgggtaataaattcttagttaacactgaaataatctgtataaaacttaacacagatctctagaacattgtaagatttcagatgttggtacctgccattgcaattgtagatgtagacttaaactagtctccctaaagttggaaacctacaatgttagccagattttgagagggctcaaaatttatttttggtgttcatattacatactattatttaattagtgatcaggccttttaattttctagttatttctatatatggatatataattggttttttattctttaggattttctacattacaccatcaggtcatttgtaaataaagataattttccttttcctctccaacattttttttttcatttgttttcttgccttattgaattgtctaagaccttcagtagaatgttgcgcttaggtgcggtggctgacgcctgtactctcaccacttgaggaggctgaggcgggtggatcacttgaggccaggagtttgagaccagcctggccaacatggcaaaaccccgtctctactaaaaatacaaaaattatccaggcatggtggtgcatgcctgtaatcccagctacttggaaggctgaggcacaagaatcgcttgaaccggggaggcagaggttgcagtgagtcaagatcatgctgctgcactccagcttgggtgacagagcaagactctgtctcaagtagacatctttggattgctcctgatcttatgggagaagtgtccaatatttcgacattaattacattgttagctataggtgttttgtagatatttataatccgattgagaatgttcccttttattcttttctttgctgaaagtttctaacatgaatggaaattgaattctgtaaaatgcttctgcattacttgagatgattgttttatttttatcctttattatgttaatgtgtcgagttatgttgaatgactttttaaatgttgaatcaacctacttgttcatgatgttattctttttctatattgttggattcagtttgcaaatattttattttattttatttattttatttttttaagcaacagtgtcttgctctgtcactcagcctgaagtgcagtggcgtaatcatagctcattgcagccttgaacttgtgggttcagttgatcctcttgcctcagcctccctagtagctccgactacaacttcgtgccaccacacccagctagtttattttagaattttgtagacagtaggggtgtcttgtgtcccaggctagtcttcaactcttgggcccaagcagtcctccctccttggcctcccaaagtgctgggattacaggcataaaccacagcacgtggcccggtttgccagtttttgagggcattccctctatgttcataaaggatttagatttagattttttattatttgtaattgctttgacagcttttttttgtataatgattatgatttgcacaccccctcctccccccgccaaaggagtcgggaaacagtagggtttgttttttgttgttgttgttttttgatacaaagtctcgctctattgcccaggctggagtgcagtggtgtgatctcggctcactgccaatctctgcctcccacgttcaagtgattctcccacctcagcctccagagtagctggaattacaggcacccatcaccacacctaatttttgtatttttgctaaagacagggttttgccacgttggccaggctggtctcgaactcctgacctcaggtgatctgcctgcctcggcctcccagagtgctgggattacaggcgtgagccaccatgcccagctaacagtagggtcatttaagcttcacataatgaagagaatgatttgcttatatattgaattgacaaacatgcattttgtgttttaattaaccattatcactccccttcagttaaaataaattcatagcatacctaagaattgagagtagctgactaatacattaggtccaaataagcagtaagtatgtatataatctttttataaaatacttttcaggacgggtgcagtggctcacacctgtaatcccagcactttttggaggctgaggtgggtggatcacctgaggtcaggagtttgagaccagcctggccaacatggtgaaacctcatctctactaaaaatacataaattagccgggcgtggtggtgcatgcctgtagtcctagctacatgggaggctgaggcaggtgaatcatttgaacctgggaggcagaggttgcagtgagccgagatagcaccacttcccaacagcctgggcgagagcgagactccatctccgccacccccccaaatatatataatttattataaatatatatattttatataaaaataataaaaaatttttttcatattaatgttttaatgataattgttaatgtgtaatgatgctacctaacacgtctttcttacagcaagcaaactaaggcagtttcttctctgtcctttcatctatttgacgtcaaaaaatagattgctgtttgagagtttgtagatgatgtcaataaagtttccattcttttgagttaaggctagtatgataattgtctaagaccacattgctctttttaaattttagttacatgagcatgcagcataccttgtggatagcatgtgggactgtgctactgagctgctgaaagactgggaatgtatgaatagcttgttactggaagagccacttagtggagaggaaggtaaggatgtttaattatgatatttttgtttagacagttttgtaagtagatttttactcattccatttatttgtccttttagttttaagacaatttgatagaaaaatcttacttcgtgcatagttttgttttcatataaatattatgctatgtaaaaagatgtaattgctgtcaacattctttatttttttgtatctgggttattttttttacccaaatgtatggatctgtggtggatagatttgggatgctgagggttttaggaaggtgatgttttctgtgataaagtaatgggattttctttagtaccttagggcagattctgtttacaggcagaagaaactgttatgtaataattacaagtggcatatagggagaagaaataagctaactctttctgactttttttttttttttttttttttttagcactaacagataggcaagagagtgctctgattgaaataatgctttgtaccattagacaagcggctgaatgtcatcctcccgtgggaagagggacaggaaaaagggtatgccaatcaatgtcttttcaatattctaaactccatttctcctttttcagtatctttttaaaaattccattttagccatgaaacaattttgttttatttttcagacaacctttgcttataaatttgttagaggtaaattttaaagcattagcaatttgagaaatttgagttctctgtaatatacttttttagttgctgcaggagatatgattgacagtccctgccttcatgactgaatgtagcatacaccatttggaatggtgcagttgtatgttttatttatggatttgctttctatttcttctaaaataaaatcagaaataaaaatggagataattttttattaaaatagggaaatttctatttcctggaatcagattttaatgcattattgtaaagtttacatgaacttgcattttataccaacaattccacaggctttcaaacttttgactgtaaagcataaaaattcattcttatattgtgacgtattacacatgaatatgtttgtgtgtgcataactgaaacaaaattttatcaaagacaatgtgatgctttctgtgttttctatttctgttttttaaaaatttctgtttcttttttgctaattgctgatagcaatttagtgttttgaatttgttacttatgtgtcatgtcccacagcctagagtaagcagaaatgctggtcaatcccagtattttatatataagctcttaaactatatttcctatttttaactgattctcctaccatctgaaggtagagttggttagtcttattggatattgattttccctataggactatccaaatttttttttgttatttcaggtggctttttgtttttataatgtgtagttttctctttcatgtcacttttagggttaatgttttatagtgaaatttttgtgtccatctcttaaaatatagttttagtaatcattttgtatgttttaactaaaacttgaacacttaacagtgctaatgggcttaataaatacagaagtctttctgttcctttaggtgcttacagcaaaggagaagaagacacagttggatgataggacaaaaatcactgagctttttgccgtggcccttcctcagttattagcaaaagtaagtttgtgtcaatatcatagtgttactaagaaatgagttttttttccctaaatgcctcacagaatattataatgctttcttattgtgatatttttaacgtgatctttatatttcacagtactctgtagatgcagaaaaggtgactaacttgttgcagttgcctcagtactttgatttggaaatatataccactggacgattagaaaaggtaagattattttgtgtaaaaaaaacctttaagaaaaattattcagttcattatatcatagcgtttgtttatatttcttaaaatgtttttttggaacgtattttaagaaaggaaacctatagcttaggtcttctgtactttagtttgacttacagaatggcggtaatgatgcttccctttgcttcatgcccacaactgtaccttcattcttagctattatatgactatgtcactgatcatttatagagactgggggtggataactagataataacaattagatgagattgggctcattcagggtggtatggccatagacgataataacaattataagacaaaatcaactaatatttattgaacacttttgctatgttctgtggattaatgtaagctcttagtatatgttagcattctcaccatagccctatgaggtaggtaatatctcccttaaagttgaggaaaaagtatggatggatcagtgtatttatttatcatgattagaaaagcaccttaaaatgtacgctctgtgttgtagacttactgtatttgaaaattttttccatggtggtatggtcatgtagtcactttatacctatcatatatgccttagttttgatgaaaaatattattattttgcagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagaggtatatattataactattacaagtattttgtcagttgagcccctctactgcagtaagctaattagtcacccaagtgttaagtcttggtgatagtccctagcagtattttgaaaagatgttcaggcttttcattctatgactcatcaggctactcctccaccaaaataggaaagtggtaagaatctgtgactcagagaaggtgaaagcaaaactaacatcttttttgttttgagaaatgatctgaacagttacctggtttttattgaaccagggctgttaaggaatagggtgttaatggaacagaaaaggagagctagatttagactaggtagcctaaaaaaagtagagtatttctaagtgttttggcagtgtaggttagggaaggacattatgttttttttttttttttggagacggagtctttctctgttgcccaggctggagcgcagtggtacgatctcggctcactgcagcttctgcctcccaggttcaagcgattctccggcctcagtcttctgagtagctgggactataggcgtgtgccactgtaccaggctaatttttgtatttttagtagagatggggtttcaccacattggccaggctggtctcgaattcctgacctcaggtgatccactcacctcggccttgcaaagtgctgggattacaggcgtgagccacacatccagtctgggttttgatattataaaactttaataagttattattattatagccgctgctactgttggagtttcctgtgttttctcttgtatttccaaagaggcttagtgcatagtacttaaatacacttgtatttttgttgtgattgttattttttccagaaatatatatttacattcagtttttttgattaaaataaaaattcataattgtcaaattaatgccattagccttttccacatcacttttatcattaatgctgtaagatcatatggactttgtgatttctagttttcttgttttattaattactcatttaacttttatttggtgtatattgttattccgggcttattaagttttactaattggaggtttgtgcaaatatgttgatgtacgatgattacattcttagttaaaaattttaatagctctactcttggctgaatataattttgattaggacaaattaaaatcaagcaatggtttaattaaatttaattactttgtagaagagttatagtttaaaaacaagtgcttttttgagagaactagagttcaacacagtagattgagtaatgtgtaagcaattttatgtttcctgtagtaagactggtaaaatttttcgaaagttaagttaccctaagttgaaaagtatattaatagatgttgatatccaaatgggaccagcatatctagtcatttttcagagggtttttccctgtttatctgtgattagtgtcatatgtcttcatgatgatatatgtttaaggtacttagattttgtcctttaggtattgtccttctgatcttcttgtcatttaagtattttattgtcctagtgcatttattactgtgaaaaaatagatgcctttataattttgtgtcaagtttacttagaagaaaaagaagaatgtcattttcgttttttctctcagttgtgatgtttctatgataaacttgtgttgacttacttccccagccatattgccttaaatttggccagatctaggtattgaatgacaaagttcatttgtgggttttgttatgttatttttcatttttcaaggtaatagtgacattttgatagcctaggagttttcactttgatggttcttaatgtataattaatatttatagggtgaagaacctgatgaagatgatgcatatcaggtattgtcaacattgaagaggatcactgcttttcataagtaagttgaattttgaagttcctgttttcttaaatctgtagaaataaacttgcatgttttgtgggttatgttaatttctaagctaatttgttgttgtcgttgtgggggcattttaaagtttactgcatttactgcattctgttaacagtcaagtccaaaacaattgtcattaggcttagctttttaataaaacttaatttttttttttttttttttttttttttacagtgcccatgacctttcaaagtgggatttatttgcttgtaattacaaactcttgaaaactggaatcgaaaatggagacatgcctgagcaggtttttatttatttgctagttacacatttatctttgaaaagtgaagtcttgtgacttttaaattttaactgtatcctttgattctttttacagattgttattcacgcactgcagtgtactcactatgtaatcctttggcaacttgctaagataactgaaagcagctctacaaaggtttgtggtggttcagtagtgtttttattagactaaatatcattaactgttttcagcaaactcacacatttaatgagatcagttatttcagtgaaatgttgcttgtttctaatgtactgttatttgtagtttgatgtatattcagtggagaggatatcgatatggtttgtttcaaggtatgatttttaattaaaaattgttgttcacatttgaaggtggcataatctgtggttttctgtattctcaaagttggtgagcaagagcctttgaaacagatataagtattagattacataaattgaagataataaaccaactccccctagatcttcttatgctctggtattgttttgggataaccttattcatattcaagatctctctagtgatgttccaaattcatgatcaatcattttctgattgaatatataatgtgccagcgccagctattagtacatatagagcttttaaagctttacccataatgataatccttaatgtgtttagtaattgaactaaacaggactgccttttccatttgtaaactggaagcttaaacattgtacttgtagtgctggatattaccttaaatattgtttgggctcatttttagaaatatcacacagtttctaagagttctggagttaggtgtttgtaggcattttcttcaaaaagtaatcctcttgataataagtttgtgttgcctaaacccacagaataatgttaaatacttagaatttctctgggcttttaagatgttgttatatctacaaatggatttttcctcttgaaaaatcaatatagtattgttaacattgtgtgcttcccgcccccccacccccaccaccttctgaggcagtcttgctctgtcatccaggcgggagtgtagtggtacaatctcggctcactgcaacctctgacttgcgggttcaagcaatcctcgtgcctcagcctcctaagtagctgaaactgcagtcatgcatctccacgcccactaacttttgcatttttagtagacatggagtttcaccatgttgaccaggcttgtgaactcctggcctcaactgatccgcgcattttggccttccaaagtgctgggattacaagcctgagccactgtgccctgcccattgtgtgctttttatcaaacacttaggaaaaagttaatttaactaaatgttaagcttgtagtaggaacggtgactatattaccatgtataattgctcacctatgttggaagttaaaaactaaactggaaaaaaggcagtatttttagtagaggaaagggatgaatataaaattatttatggtaagccaggcacagtggctcacgcctgtactcccaatgctttgggaggctgaggaaggccactcacttgaagtcaggagttcgagaccagcctggccaacatggtgaaaccttgtctctattaaaaatacaaaaattagccaggtgtgatggtatgcacctgtaatctcagctactcaggatgctgaggcaggagaattaattgcctgaacccaggaggtagaagttgcagtgagctgagatcatgtcactgcacttcagcctgggcaatagagtgagctccatctcaaaaaaaaaaaacccaataaaaataaaaagtttgagatattttaaagtttatagtaataccacaaaatattttccattctgagtttttataaaatacagcagtatccttccaacaagaaatggaagatgctgtttcttttttattattttattccatttatgggttgaccacccttgaaataatgtgagcatggagcgtaaatctttattagcattctgtgctagtggctttattaaagattgccatatcaattatataagtcttctcatcctcttaatatcctaaagccttaggatattatctattaatgtacctcatatttttaaggctgcaatttggtgagatttgtaagacaaaccgtctctttgttttcatttcttataaattataaggaagaaatttaaatcaaatgcagaagtagagttaataaagctatgagataatgttttacataattgaaaacattttaaagaaatgctgaattgtttatacaatattttttaaaagttaatgttaaattttttcaaggaggacttgctgcgtttaaagaaacaaatgagagtattttgtcagatatgtcaacattacctgaccaacgtgaatactactgttaaggaacaggttagtaattactatagatggtaatctttttgtaagcaacctttataaaatctgaactaatgtagaaagtttaaataatactaagattgagcaaagcagaaatatcttgtatctgcctatgtatattatactaaaaaaataggttaatatattggatttgtgcataataaaattgattaatttcatatggggtttataattgcattatagattacccttattgtcattttatgttgttgtttctttatgacacatggtaaacagacttcatacaaattatagatgtatgaaattaacaaaagtcattcctgaaagcaactaatatgacaagtttgttccagggtagaaaagtccacagggttttgttatctctgagagtatcagatgttggcattctcgctcatcctgatcttcctgtggaccttctctgaaataaacatttataatcacttccctgtcttccaagtgttaccttcccaacgcgtatgccttcatgcttccattacttctaaccttttcagttctcgaaatagactgttacctggtttgatcctagaactaacatcatgttcaattctaattccctaattgagaggattaagcttcgttggaaacgtgcttttcaaatgcttttatgggaagatgttttcacaagcattccataagaactattaatatggtatagtcaaaatgattatggtgatttcaaggtttgcaaccatttcatacagcttaacctttgttttttcaggtagaatcccaatagtcaacctgactatgatttttggacactgtgatatgttaggtactatttattttagttcagtgttattcaaatataaccagccctttgtttggcacttgtctttatttaatttaaaaataccgaagctaattttaataaaacatatttggatttttatagtttaaaatgttcattcaatgcccagctggtagtctctttttttcttatttccagctctctcttgtccctaccatacatatatgcttggtcacacatgccaagatgcagttactgaattttgctatttttttccaaaaatatgaagtatattgccataactattgcattgcagaattctctccaattttacgtgtgtagttttgaactatagcaataaagggtgtggtactttaattttcatctctataattcagatgaaaggaacaagatttctgatggtagtaaattgaatttagatttaaactcttggaataggattttaatgacatgcacagatcgaaacctaatgcacgaaatattactttataattgcatgggacaccaagatattcagcataataatccctatttttatagcattaacacataatccttgtgggttatcctgtgtaacctcctatataatcccttgctcaggccatagagattaattatttagttattaaacagcttatgtgcccagtcttcccaacagcttcccagaatgtgtcctggtcagctcacttgatttgccagttcagctaattagtaaatatcatcatacttaatactttatatccttactctttatgttgcaagtttttgtagactgaaatatgctaataggtataaattactactatagtagttaggagaagagactgaaggaaggggtaaaaacataaagagaaaaagtaaatgtggttagttccaaagtggcaaaactcttaataagatctgctttgtgctctgtattatattgtctttccaggaatgatcttcctttaaatgtattttctggtttactttgtgaccctaaatttctattttcattaccccttcccaacaaataattaattagtctgtgactccatttaaaacccatggcagagtttttattaagctccttgagatacaacttcagccttatgtttattataatatgttcaggtttacctgataaatagtaagcagccctgtatctggttatgttttcgctacttaatcagtacacgtgtgaacaatgagagtgcttaataagtaccatagattttgtgatctctattctaatacttatctctttaatgttttttcttctgtagagtgaagagtggtaccaagtttatacattatttcatatttgagaatgaataccttggggcattgcaatatagagcaaagtaggggatttggagttagaaaacatgagtttgagtcctgaccctgcatatttttgtagtgtgtaacatattgtacaagtcacttaatgttgctgaaaattaaaaaaaatttgtgaaattactttgcagttagtaaagccttatacaaatataagcattcgttgttacataaattatacttcgcagctttagaatcttaggaaaatactaaacattgatttctcttaagatttttaaatatagaaagttggattctgtttctgtgttaaatatgtaaattatttgtggcagttagtgagaaaccttggattatagcatgctttcctcttttttttttttttaaataggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcaggtaattttattgccatctttttattaaatctgtgtccaccataaaatcaaacttaagtaacaatgatgtacatcggtgcactaaaatatattttatccttaaaaacgtgaaacacaggtatatattccagcacaatttatgttcatttttttgtactattgtaaagaaaacgtgatgttgcagagtataggctttcaagtcagatcgctgcttctcactagcactgagtctgctttctaatttctaactacctcataaaactgttaaaaattgagtcaaatgactagtacagtgcctggacatatagcaggtactcaataaaatttattccctcttgcccttattcattggtaataccaatatgcagataatttggaaagaataaagtatttatgtgactttttgttgtgtacttgtataccgtaggttttttttgttttttaatttggggagtattaatttgatttctgaatgttagaaaaatgtttgaaactgctctgtaaaagtctggggcagtatataatgtttacaggaaaagaatcaaaccagcctttcctagtgttaagttactcttcacaccctaattgtttacacaccctaattgccttactttagcatgaggttatggaaaagaagtgatatttggcggcatctttctgggtttgtttttagtttgaaggtatattttttgtttatttttattttttagaaacagagtctcactctgttgcccagcctggagtacagtagcatgatattagctcactgcaccctcaaactctgaccaaagcagtcctccccctttagcctcctgagtagctaggactacaggtggtgtgccaccgtgcttggctaattttttgtagacatggggtcttgatatgttgcccaggctggtcttgaattcctggtctcaagtgatcttcttgcctcggcctcccaaactgtgaagttaaaacttaaaggaaaatacaacatcaacatgtatatatccatactgatgtatcactgcatatcagggtgtaagtatatatgtaattctgtatatggcatgtagcttacttttagcaatagagagctttgtgctcatgtactaaaaacttaacctcaacacaaatgagaaacccagagtagccaaaacagttgtcagaatccatgtagtgaagtttatatactttgagtttttcatctgtcactctaagctattggcttagttatgcttttgttcataacattgatttgacaaacatttattggtcagcaggcagtttactagatggtatggatatgaaaagatgagacaaggtctcatccttcaagaattaaattcaggatgaaaagaaccaagtaattatagtgttgttgttgttgtttgtttgtttgtttgtttgttttgagatggagtctcactctgctatccagggtggagtgcagtggcacaatcttggctcactgcaacctctgcctcccgggttcaaatggttttcctgccttagcctcctgagtagctgggattataggtgcccaccaccacgcccagctaatttttcttttttttttctttctttctttctttctttcttttttttttttttttttttagtagagacggggtttcaccatgttggccaggctggtcttgaactcttgacctcaggtcatctgcctgcctgggcctcccaaagtactgggattacaggcatgagccactgcgcccggcctatagtgcaatttttgataagtaatggaggcatgtacaaagtgttgtgggcatgtagagtaagttctcactgatctgcaggtattgaaacatcttttgagaagctaacaactgaagttaatccaaaaaatgaataggactttataaaacgtctttttttaaaacttctaaaacgtctatgagaaagtacagttggattctaaaacctgatacaaaataagttttagtacataaccgttttgttaatttggggctgccttagcttcatttagtccatggggagttgaattagagtaagcttgccaaaactcttgatttatctaggagcttcctagaattacccacacttcttatctccttagacttgtgtgtgtgtatgtgtgtgtttgtgtgtgacagggtctcactgtgtcacccaggctggagtgaagtggtgtggacttcatatagctcattgcagcctaaatctcccaggtacaaatgattctcccacctcagtctctggagtagctgggactcaagcgtgtgccactctgcctggctaatttatttaatttttagtagagacgaggtctcgctgtgtagcccagcgtggtttcaaactcctgggctcaagcagtcctctcatcttggcttctcaaggtgctgggattacagatgtgagccactacacctggcactattttcacttttaaaatgaagtgcattctagtccaatggaagagtataaaatataacagatttttacataaccattccatcagtctttgtcaaatttagctgtgtttgttttaggttttttaaagaaataaaagcacagttacaaaagaagccctcatttgtattcctcccttatcccattatcctcccattttccctagagataactgctaccccaaatttgttgtttatcacacctttgcatttcaattttattttactaagaatttgtatctgttaataatacatagttcatttattcttgctaacttccatgtaaatgatattaggttgaacattttgcaatttaccttttttcttctttttaaaatatgaaatgagatcttgctatattgctcaggctggcctcaacctcctgggctcaaacagtactcttgcctcagcctcctcagtatccgggattataggcacatgccactgcacccagtgcagttttcctttttgaatttacattcttgagatttttttcagtgttgacatgtggctacaattcatttattctaactgctgaatattatatgatacaagttaactacagtttatccattttcttatttttagacatttaggttatttctactttttcctcaattaaaatagcgttacaacaaatatttcaatgcttagctccttgagcacatatacatttgcttttctagtgtatacctgagtggaattgctagattatgtagtgtgtgtgcatcttaaacttgatcatattttgctaaagtggttgtattgttttaccctccttccagcagcatatgatagtttccattgttactcatcctcacctaacatctagtattgtagacccttggatattgtatttgttagcctacatcagattagaaagggagagtaaaatagggaatgctcctagaggcatttcattgacaatacataataataatggcagctgacacttatgaaaggcccagtgtgttaggtacttctctacattccttaacatccacaagagaaaaagttggctaattcttgacaagccattagtggagaaaaataaaaatcaggacttaaaaactctgaatatcataggatagtttagtctttagagggaaaatgtctgtatgcgattggaaacaatgtcatgtagaaattgtccattatagtgacagagctattaagaaaatgttactttatgtattcagtgtaatgatatgtcttaggtttctaagcaaatagtgttgcatcttgggacatacatttgagataaaactttctctgatggtctatcttaaattcttactctttaaatttggttttagtttactagaagttatcaaagattaccagagacaggatgaaaaattaattaaatgaaggaacattcttactatacataaaatagtttttgatattgggaaccttatattggagcttataggatatgcgcagactgttcaccagaggaattataaatggctaataaacataaacaattttaatttcatttaacaagggatagtggtttgtttgtttgtttagatggagtttcactcttgttgcccagtctggagtgcagtggcgtgatcttggctcactgcaacctccacctcccgggttcaagcaattctcctgcctcagcctcccaactaggtgggagtataggcgcgtgctaccacacccagctgatttttgtatttttagtagagatggggtttcaccatgttggccaagctggtctcaaactcctgacctcagatgatccgcctgctttggcctcccaaagtgctgggattataggtgtgagccaccacacccggcctgggatagtggtttttgttttgtttttttacaagtaatttcatttgtaaaatctgtccagagggaaaaatttttgtatgcagcttttttttttaatataaaaagcttcatctagttttatttacagtatccaataagtaaaacaattattttgcattacttggaggctgcagtggggcttccctgactgcgaatttggaaataagtttgtcttcttgagaattgaatgtcaagatttcacataatggatcagagtagaaatatgcaagattattttaaaaagacagaatggtttctggggcctgtctagctgaatatatgtacaaaggaggactgttatagccagattttggggtttgaggtaaggtgggatcatccttggaagggataggagaaattctgaggttggcagtgttcaggaacgtaggagccttaactaacagactttgagtgtgcagattttgttgacaaactatcctgctagggaagtagacaaatgttaggcaagtttagcctgacttcagtaggtgaacatggaatacgaacaaatggagtgattcagttccatttgttctgatcatcatttgatgtcacaaaaatttagtctattggaataaattatgaatggttataattttaattttaatgtttttcccttttcaaattctcttataaaagcatgtttcatagtgagaattaaaaaaaatacatggttgaaataaaatacaagatgcttaatgtttgggactttttctccagatggtcagcaagaggatgaagccagtaaaattgaagctctgcacaagagaagaaatttacttgcagcattttgtaagctaattgtatatactgtggtggagatgaatacagctgcagatatcttcaaacagtatatgaaggtaaagttgaaaaatggatagcaagatagttttaaaatgcaacgctagtttttatgcatggctgccattgaattctttaagggcaaattacatttctagtgtaaaagagttgtattttaaaatatttagtgttttcaatacatttccttatacctctactccagttaatggacattttgggtttattgtgttcgtttgcatttagaatattggagatggcccctctcaatttgtcactatcagaaatagcatgtatgattcagtttaagataataggatggcattcctcctctgcttgatgtagcattaaaaagagtttcaggagtcagaagacttgggtggtagttttggcttggttactatgcatcttgcgaccttgaataactccaagcattttgtgacctgagttcctttatctgttccactgtgattgttaaggttttcccctttggttctcaaagtctgatttgattaaccataggttattcataattttcataactatatgtgaggttttgttaagttgaaagtagtgataaacaggatattgttgattatactaacagaatgtgactaaatgtggtaagatagcttaaaaatccttcctcaactaaaatctaattataaatgtaaactttttaaagcctttgctttcaagaaataaaatatgtaatatatttaaacctagttaatcctctctggaatattttgctacttgaactctaatatcattgaaaattattttggaacttaaatcatttgggatgataattaccaggtttttttttttttaaactaaggttgtttatgaagttatttaacaaattttaaagttttagtcttaggtattctaaagtcacttactagtcatagggacgtggttattctgttatctctgataattgttattgtacgtgtttgaaacacaatcttaaattaggaaaaaatttcatgtgcaatgtgtaatgtaaatgtcatataaacaacttttaaaagttgtttatatgctttccttttaaaagttgtttataggctgttagattctataagccaaattaataaagttttaaactgctcgtggcctgtatacccggtatcaatgaattagttataagtgtaactgagattatatttattgttttacaaagagaattttgtttgtacattttgtgttacttctgaaaatctgcataacctaattgttgttttgactaaaactgaccagtataccgtctttattttaaccaagtctggagcttaatttgattagatcttaactgttttgtatatatgattttactgaagttagggattgtatgcttagaaatgatctttaggtttcagtaacattctttcctgcctttgaaggcataattttggctaaatacatactttgtgacgtgtttacatgactaacctaaaatttgtcttattgtcaagtagttttaagagataaagctctaatttgtacaaatttctttatagtattataatgactatggagatatcatcaaagaaacaatgagtaaaacaaggcagatagacaaaattcagtgtgctaagacccttattctcagtctgcaacaggtaagcattaagagtaccaactttagctaacacaattaacacctaatagttagcaaaataaggtagcagttgaaattgggcaaagtgtgcaataggcaatttataaaagtagaaatacaagaaagtataagtgagattatttttttgctttcaaactgtcaagattggcaaaacctatagctatctaaggtatggaggaaatatagatatggtaggcaatttggcaatttatgtaaaaatttataatgtgtatgccatttgaggcagcaattctactttttaaatctactcttttatccaaggtgataagacaagtttgcaaaagttgatatacaaagttgtatattgcaatgttgtttataggaagtaagacataatctaaaagtctattaggatattagataaatttactgtatagtacatttctgcgatgaccgttgtacaacacttaaaattagtgtagatctatattcattaatgtataaagagcttcataatcacaaaatatattaacagtggttaacttgttttggtagatttcatgttgaattctacttttttctctgtatatttccaaacttatttttgtgagcatatattaattttataactaaaacacaatagttttggccaggcacagtggctcattcctgtaatcccagtgctttgggaggctgaggtgggtggatcacctgagatcaggaattcgagaccagcctggccaacatggtgaaaccccgtctctactaaaaatacaaaaattagctgggcatgatgatgtgagcctataatcccagccacttgggaggctgaggcacgagaattgcttgaacctcgtaggtggaggttgcaatgagccaagatcatgccactgcactccagcctgggcgacagagtgagactctgtctcaaaacaaacaaacaaaaaaaccaatagttttcattttggcagtgttgaggcatttaattagataaaattactgacttagtatacttttgtctttggagacaaaatttgcatgcaaaacccaacccaacccattccaacttaatgaactttcttttaggaatgtccttttttttttttccttttcttttgagacggagtctcgccctgtcgcccaggctggagtgcagtggcgtgatcttggctcactgcaggctccacctcccaggttcacgccattctcctgcctcagcctcccaagtagctgggactacaggcacccgccaccacacccggctaatttttttgtatttttagtagagacggggtttcaccgtgttagctaggatggtctcaatctcctgacctcgtgatccacctgcctcggcctcccaaagtgctgggattacaggcgtgagccaccgtacccagccaggaatgttcttaattttatttgagaatttgaattttctctattaaaattaataaaatgtaggctgggtgtagtggctgatgcctgtaatcccagcactttgggaggccaaggttgagaattgcttgagcccaggagttggaggccagcctgggcaacatagcaagagcccatctctacagaaaatgaagaaagaaaaataaataaaatttaaaaggttgaaaagatggcatttaaaaaataacttttgctataaagtaatagctgctagctgtactgtttagaaaatataaaaaggaacaaatgcaaattatccttaatgttttcacttcacaataacctttttgttttttgatggccttgttactcttttttatgcgtacatgaaatctgattttttaacaaaattaaattgtgcattccattttgtaaggctgcattttaatattaataaacactgaacacatttatgccattaaataatttcctcagcatcttttttttttttggagcaggagaggttcatttatttttttttctagatttttgtgaaggtataattgaaaagtaagaattctgtgtacttaacggtatacagcatgatgttttgataggtatgcattgtgaaatgattaaatttagctaattaacataaacattacatcacatacttacttgtggtaagaacatttaagaccaactgttctagcagtttttagataaacagtacagtacattactcttaactatggtcaccatgctgtacaatagatcttcagaacttacttatcctgtcctactgaaacgttgttccctttgaccaaagtctcagcctcccccaacccccagtccctggcaaccaccattctgttctctgcttctatgagtgcagatatttcctcaacatgtggatttcattttctctgggtgtatacccagaagtcttcctccttttaaaaagttgacacacgaccgggcgcggtggctcacatctgtaatccaagcactttgggagactgaggcgggcagatcacgaggtcaggagttcgaaagcagcctggccaatatggtgaaaccccatctctactacaaatacaaaaattagctgggcttggtggcacacacctttaatcgcagctactcgggaggctgaggcaggagaatggcgtgaacccgggaggtggaggttgcagtgagccaagatcatgccactgcactccagcctgggtgatagaacgagactctgtctccaaaaaaaaaaagttgacacataattgtacatatttatggggtgtacatagtgatgttttgacacagtgtatagttaaccaaagcaggatgattagcatatccattttgacgactatataatattccattttatagatagaccacaatttaaccaaagtctccttgtttacgctgaggtttttttacaagttttgttattacaaatagcactaaaacttttttgtacatattattgtgcataaatattatttcttttggttcaagtcctataattagaattgctttgtcaaagaagattaaaattcttaagcttttgctatttcatgttaagagttcttgatgtaaagattcaccacttaaacgtaaataacagagcatggttgcctaataatttgctggggttttttttcccctttatatttttatatgctatgttaatatccaattaataccagcaggatagcattctgccaaaactaacctgaagggtttctaatgttaataaaaacctccagtttaaatatacgaagtactgcacttttggtcatttgcatcatgttttagtgttttgcaataaaatacagtgcctcatttattgaacacctgtattttaaatgaaaatgtaatattttaaaagatgttaatctccaggtattaagaactttaacatgctttctttctttccaaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaagtaatctccagatattttattcagctctcatattttttagtcatgaaactttatttttaaatctagccctttcatttggaataactaaattaaatttatgctttattattagcttataaatctctaccctatctcctttcttaattttaaagaaccagttacagtgctatctcaattaacaaatgagttgggccaggcttggtgctcatgcctgtaatcccagcactttgggaggctgaggcaggaggatcacttgaggccagtagtttgagaacagcctggccaacatggtgaaacccgtctctactaaaaatagaaaaattagctgggagtgggggtgtgcacctctagtcccagcaactcaggtatgagaatggctcgaaccttggaggcagagggtgcagtgagctgagattgcgccactgcactccagcctgggggacagagcgaggctctgtctcaacaacaacaacaataaaatgagttaggattaaaactccgtttataagcctttgtttaaatttaaaccatacaaagtctataaattatgtgaatcaaagcagcataaattcaagcattacacatcttttttatcaacttttgtcatgatctcattgtcagatagagaaatctttgaggtttgattcctttgtctcaagttttttctttggttctgcactcttactttgtagtgaccttttcccatgttttgatccacacccttctttccatctgcatattttgttgcccttatcaaaattggaagtcgttttattttatactgggcatgtaatttagtgatcaattgcacttttaaagtatgggtacattttagacctttaacataaccaacatttgtgtattaaaaccctttatctgttacctgtgggttaaagaaccttgcttttagattctcggactctccttcatcctcttgctcatttagttataaaagtgctaactgtctctctgaggaaaatatgctgctcttgtttaagttttgcttctactccctcaacttaattattattattattttgttttttgtagagacagggtctcaccatgttgcccaggctggtcttgaacccctggcctcaagagatcctcccacttaggccaccaaaagcactaggattataggtgtgaaccaccacacccagcttcctccctcaactttaattaactctctcctttcactttcttctaaaactgaagtttatttttatgcatccattagatggtaattttacataatatttaaggactacctgtatattattttcagaaataatatctttttttcatgtaatatccttttttccttcttgattccatctggattgttttttactcagttacatatttgatagagttataatgttgggttgttattttgatgaatagaggtatttatcgtcacataaatatagttaaaatgggccttagatggggtttaattttactcttgaattgtttattacaaatgtttgtgaattattttttaacgttctatatgttagagtaggtctcctttatgtcttgaaaaatacagataatgtattgatcattatgtgagagaatttacattattttctatggaaaaaagtactgattaaagaatgtagatataccagaccatattcagactgaaagctaagtggcgtgtgtgtgtgtttgtgtgtgtgtgtgtgtattgttttaaagaaagtaacagtgacataaaatgtcagtatatctgcacattctcacactttacaacctgcttattttctattcctcaaattaaaagcttggcaaaggaagtagtgagtgaaatttcctaagttattgacttttttattatagtccctcaaatatttatttcaattattttttgttttcctttgcagagatggcatagaatttgcttttaaagagcctaatccgcaaggggagagccatccacctttaaatttggcatttcttgatattctgagtgaattttcttctaaactacttcgacaagacaaaagaacagtgtatgtatttgctggaaatgtcctatttaatttcattttgggattcttaagggcaatttttatacttggtttctctcctttctactcacacagaattgtaggattgcattaatacacaaaaaagtttatacttcagcaactttataatttaaggattataactgtgttttatgcataatactctattttaatattgtgagttttcctccagtataattttggcttttgacacgtaatttgaatactttatgtattatttaagagactggactcactatgttgcccagactggctttgaactcctgggctccagtgattttcctgccttaatctgagtagctgggactgtaggcaggaaccactgcctggctgctttttgtgttattatctgcatttgtgccttaacccaactaaggagggagcatttgaaaaagaataataaaggcaatccatcaggaacatcctttaattctcaaacagggcacttttctggtttagtctccaataatagtgacttataaaagagcccccaaaatggatttaaattctcaaaaatcttctacctttcgccatggctttgaggtgtaaaagggcagaagcgtatggatacctcatattgtaaataatcttgtctgaaaactcactagtattttgcatttaaagactatagattttatatgaaattctaaagcaggcaaaactaatgtatggtgataaaaattacagtaacggttacttctagtgttggagagtttgaatgggaacactagggtactagagttctgtatctttttttttttttgaaatgaagttaggtctgtccttcaggcaccatctcggcccactgcaaactctgcctcctgggttcaagtgattctcctgcctcagcctcctgcgtaggtgggattacaggcgtgcaccaccatgcccggctaattttgtatttttagtagagacagggtttcaccatgttggccaggctagtctcaaactcgtgacctcaggtgatctgtccaccttggcctcgcaaagtgctgggattacagacgtgaaccactgtgccctgccaagttctgtatcttgttaggtatgtgggtcacacaggtctatgttcagttataaaactgatacaactgtgctcttagttttgtgtgttctattgtatataaatttatcccagttaaaattgcataagcagtattaatcagagaaataaaaattaaaacaaataccatttctcacctagcacattaggaaaaattaagaagtctgatagtgtcaagtattgccaaggatgtgaggcagcagagccttttatacattgttggtgacagtacaagaccattttgtggagctctttggcaatgcctagtaaagtttaagattctctctacctcatgatccagtaatttcattcataagtagataccccacagaaactcctgaatacatgcacaaggagaccgataaaagaatgatggctgtttgattgtttgaaatagtggaaaaactcaaaataacctaaacatccatcaactgaaaatggatcaatagattgatatataatggaataccatacaacagtaaaaatagctggatttcattgagtacaaacagcaaagtacaaaactgtactatgatgtttacagacaactatgtattgaatgtacaaaatgtgcatgggggtgataagtagtggtaacctctgggcacgaggaggaagcaaaatggggatagctttagtgcgggctacttatctgtaatgtcctatttaggtatgtggtgggtacataattgtaaatctctctgccagtgagtatattttggctcaagttttgtatcttgttgcagacttaacagtttttggagtggtagccagttcacaggccacacttggaggagtactgtactactatatatgactgaagtgtattgtaatacagaaagacatactgggagtcgggtgccgcggctcacacctgtaatcccagcattttgggaggtcaaggcgggcagagagttcgagagcaatctggccaacatggtgaaaccctgtctctacaaaagatgcaaaaattagccaggcatggcagtgtgcacctgtaatcccagctactcaggaggccgaggcaggagaatcgcttgaacctgggagacggagttgcagtgagccgagatggcaccactgcactacagcctcgatgacagagtgagactgtgtctcaaaaaaaaaaaaaaaaaaaaaaagagaaaggcacactgaacagctaacaaagcagtatgctttgtgactgatttctcctattctctttaatgctgttcacactggtgaatctgaattgatagaaatcagtcattacaatgacagcaaatatttgaattgcactttacagttaattgacaaatagttgtctttatttgaagcataatttagccttatagaactcttggtgtcagagccttggacttgaatcatagttatgctgcctactcatttttattactgtgggattacttcttaatttcaattatcctttctttcgtcacctgtaaaattgggaaaacatttccctcatagaattgtaagaatagttaaggaacctgaggaaaaaaaaaatatctagcacatagtcgtcacatgaacgttagttgaattttgattgcaaaattacatataagccttgagatacttggatccaagggtagatttatgatttccatcaggctgaaacttttttgcaggtaggtatcatatcatatccatctttgtatctatccatagtgcctgggacataataggtactcagcaaatgttaaactgagtgctctgaattatttcatttgatgtgaaaatcttggcagagacaacattgttcattaatgtcctgtaaggctgagtttgagtagtgaagtaatatgcctatgctcgcacaactatgagttaatataacccacagatttctgtatcaaagctaacagtttcgatttcttttcaaggtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcagtaaggatataatttattctctttatatttatccctaatgtttaccaactgaattgtcattaaggttcaccttattttttatttgagatgtgttcaataatagcttacaaaatgtgttcattatgtgtaaacatgctgttgtaggcattttagatacataaactcagttctcacaactttttgggtacatcttcatttttcagatgacagtacttaacacagagaggttaagtaacatactcatgtcacagttattaagtaggagagccatgcagtttcactgtagagtgcctgctttttaaaatctgtgctacactgtatgcatagggaaatggactcagtattatagagctagttattacccaagagatcagatcatctagttaaagtggaacaacagattcagagaggttgcaacttctgaattcctatgaagaggccattaatcatgaagaacttcatagaaatagagtgctatcgtattagaggtaggaatgcattatgacgcttgaagctcttagactcctagcactccagagttggttcaaaatgggcctggggacttttttctttttcttaggaattattaaattagcatagttgtcaaaatttgtcccagttattattgttgaatagcaaattacctcaaaacttaggacatagccaggatcatggtgtctggtacctcagccaggaaggctcaaaggctggtggctgaaatcatacggaggcatcttcacttacatatctgatgctggctgtcatttgggacctcagctgtactgtctgccagaacaccaacgtgtgacttctccatgtcagcataacactaggctccaagagcaagtgtcccgaaagaccagaagtggaaggtgccaatttcttaaggcctgggcccaaaaactagcatagcgtaatttctgccatattctattggccaagcaatcacagagattctaggggagaggacataattcttaacctcttaatgtgaggaacgtcaaagaattttggggccatatttttaaattgccacataactcatcagctttcatttatgatcaagtgcttagtgtttaaaacttgattgtcctatgaattttagtatcttttgtccagtagtataaaggcataaccttatatttctaacttgtacaattttacactggttagttatatagtcccaacatcacagttgatggggaaatctcttttattaccctgggccagttaaagtagttagggctgatggtttataagttaaaagaaacttttctgttttttaaaaacaaaatgttatcaaattgaaagatgatgttttctcatatcactaaatttttgaaagtttttatcatctgaactagtagttaatagttataggtgtgtgctgggccatcaaatctctctctctctttttttttagacctcatggaaacacatgaatgggtatttatattacagaaatctctcttttttttttagacctcatggaaacacatatgaattggtatttatatcacattttacaaatagattattaaaccagatacgtcaatttttacaggaagaatcaatgctctcattcaggtttttggggagaatcatagaaattggggcattaataagttaacagaaggaagtatgaatactgataggttggccaagtcaatgcaattttgaagacagtattggagcctgaatgcagtagaacttaaaggctgatgtaattatattgcaaaatgtggagtttatgtttaatctattattagagtattagctattcatgcattttctttccactcttattccttaaaaccttacacacatttgcaaatatgtataatcttttttttttttttttttgatggagttttgctctttttgcccaggctggagtgcaatggtgtgatgttggctcaccgcaacctccccctcccttgttcaagcgattctcctgcctcagcctcccaagtagctgggattacaggcatgcgccaccacacctggctaattttgtatttttagtagagacagggtttctccatgttggtcaggctggtctcgaactcccaacctcaggtgatctgcccacctcggcctcccaaagtgctgggattacaggtgtgagccactgcgcctggcctttttttttttttttcttttgagatggagtcttgctctgttgctgaggctggagtgcagtggtgtgatctgagctcactgcaacctccacctcccaggttgaagcaattctcttgcctcagcctcccaagtagctgggattacaagcgcccgccaccgcacctggctaatttttgtatttttagtaaagatgggatttcaccatctttgccaggctcgaactcctgacctcgtgatccgcctgtctcagcctcccaaagtgctgggattataggcgtgagccactacgcctggcctcatatgtataatcttctaatgaaatagttttcttctaaattcacaatcaaaaagtgctatcaatttttttctcccaggtcagtgattttaaaaattactattaattcagtaacaattgtacacaaatttgacttattaattatggcaacatttacagacatttgaaaaaagtagcttttgcaggtgtgaaaccttttttctttttagtccaatgcttaattaatatttgtatagatttgtggcccccttgcagttgcctcttactacctgctcagtggtctgcatcccataggttgggaaccagtctcctattgcttccatccctgttgccatttctcactcacctaggccacacaattagccttttaactggtctgtttgctcaccggtattctgtttttaagttcactccccacactgccaccacattgactaaaacatgtaactcaccaaattgcttccctaccttaaaaccttcagcagcagttccctgttaccttagaagagctcacaagattttccacagtttgattcctgcttctttatccagccttgtcttttgctaccctttcaatctttatgccccaggagtagcaaactgttagttttgaaccatatgaaattgccctttttgtaggtcaaatatcagcagattaatagggttcagtcgactgggtgcgatgtctcacacttgtaatcccagcactataggaggccaaggcaggcagatcatttgaggccaggaattcaagaccagcctagccaacgtgctgaaaccctgtctctactaaaaatataaaaattagccagacatggtaatgcattcctgtaatctaagctacttgggaggctgaggcaggagaattgattgaacccaggaggtggaggttgcagtgagctgagattgcgccactatactccagcctgggtgacagagcgagactctgtctcaaaaaaaaaaaaaaaaaaaaaaaaaaggtttagtccttgtttcctgccttagtgttcttgctttatgttcttctccctgcctagaataaaaagcctttctagcccacctgatacctactctagttagaagttgcttctggatagctggctctgacccctttcactgcccccattccccttatacttccctctctccttgcatttaccacactgtattttaattgcctggttgttttgtgtcgcaactagactctaaggccaggtcagggactgccccttacataggtttgtgtcccccgttcctgtgacttgcatgtggaaatcaacagatgtttattgacctgaacaggttgtattagacatctgaatagtcaaaattagtgactaaacctcgtcgttaattttcttttccagctgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataagtaagtacatttgatcattttctgtactataactttattaattacatagaaaaagttaagttaaaagaggaataaaattctccttgaagcacgcaggtaacatggatgttagctcaaagacaacaagaggaagcaaggcaacagcaggagagagcagcaatgagctatgttaaactgcgaactaatcttcagcatgccatgtaagtgagagtgccttattgtctgagtctaggaagttcactaattcattttaacattttaatgtgtgccttatctaaaaatttcagcaaactctctagagtaacctaagctgaaataatcaaggaactaaaaattggtctttccaacagaaaagcaaaatattttaattaaaatactacctagttagccaaaggaccaatcttaggttgatctgttggaaaagtttaaatatcaatccttgtttattttggtacacagcattaaaaatacagttgtgttacatcctaattgattttcccaacttagttcaggccctcatctctcacctgaactattgtattagctttctaactggttttcttccctcaaatctcccatttattttctcaccaaacctctcccttcaccccccgctccatcattcacaccaccatcaagaattactattctagaataaaaatcttaccatgtaactcttacttaaaacctttctgtggctccccattgcctgctggataaactcccaacttccttagctcatggcatgcaagatgtttcaaaatatggcccctgccacgttttagtatcatttcctattccctggcagctggtaaaatcatcataaaagaacaagctcaggtgtcactttaactgaagctttggtcatctatgctcccataacactatgtatatccatatttcttatagcacttgccacattgtattgtaaatatttgtttatgagtttgtcccgtttgtctagactgtgagctcctcaagggcagggaccacattcattgcctatcagtgcttggcacgtaaaaggtgctaagtaaatgttcattgaatgaataaatgttcaatgctaaaaaaatgaagtttatcttttaaatactttgtttttactggattatgtatgataactttataaatctttctaaaatcttcattagctttggctctaaaaaacatggcagacaagcagtctttagataatttttttaaatgtcttgattggtatacagggaaaagtgtgatgattatgattaagtttttgagtttgaaagcattgtatttataatgtggtatatgttttactattgggagatagtagttgttaccctcttctttttttaatttatattttgttctgtcttgttggtttttagatgttaagaattttacctgtttttcttacaaaatgatcatttactatgagtggtggcctgcataaattcactttagttatctccatagtggtcttaacctctagagacacaaggtatactctattacacgtatagattctgatcctggttaatatggtcatcatctatattgtcacatagttctatccccttttgtctgtttctgtgaccacattccttttaatataagttcttattttatgctggatcctacaactgatttcttggcttccaagtagtcgccggtccatatattccagaattctgccatgcaatcatttggtctatatctctccccataaaacattacaccagttcctaagatcctatatagcatgtcactacttagtaccattttaattcccaattatagttaactcccccgcctcccggcaactacaagaaattatctcagttaaatgactattaccaaaggattctttggtggttgtaccataagtcatctattgcatgggactctaaagcattttcatcttacaatgatttttctataatggtatctgccctataactaaaaatacttccaaattttcttttttatttttcatagcttgtatcacatatatcttccttgtacttcaaacaaaatgcagaacggctttctgattttctgtcacatagttcatacagcacatatattcccttcacggttgcctctacaaaatatagtaaaattgtctttctacccagaactgttaggaagtaaggaccattataaacatatttgtccaggtaacatggatcagagatcgtatcttgttatctttatatcttttaagaaccagcatagtattgtgtaaattgtaagcattcggtaaataattgctggggttttggcaactttcttgactgtgggggtgtctttggatgagaaaagaaggtaatgttggccaaactagggaaaaacaagtcctactcagtttcactattatgttggctactttatgctgatctgggctaatttgtgaacttaatttattccccataattatgtaataacatatataacttttggtcttagtttttcattttaaatttctaaatatgtcttagttttgagtttcatagggcacacgaatctgaagtttcagcatgagtgttcctcatttcttcctgaggcagaattaattccttattttagtatgtccttataacacttgatgcatagttttcttgtaatatttatcacattttgtcataattaattgtttatctctgtttgccatggtagactgtaagctccttgagggcaggaatcatgtcttagtcttattcatcttttttttttttttttttttaacatccataggacacagtagaagcctgtcacgtagtaggcattgtgtgagtgagtgcgcgcatgcctggtacacattaggtactgaatgaatgagggagtgatgatgggtaaaattagcattatatattgatgaaaatatatgttttctgaaaatgtcatttttttggtctctgttttatgtttgtttattaatttgtaccctgcctactttcaaaaaggatttgaggtatcttgtatgttcccatgtgggaaattctcattgaaccttgtatatgggatatcagaactataaagctaaatgtactgaagtaatgtagaataaacataactccttagcatttttagacaagtaaacattgggttttgatatcattgatgacataatcaatgcctaatcattctccctgacctttaattccatcattttccattatacttgaatatagagagccacatactgctgcctagatattaatagtcacgacattagttcagatcttgactttgttttatatttctctagtcggcgtggcacaagcctaatggaagatgatgaagagccaattgtggaagatgttatgatgtcctcagaagggaggattgaggatcttaatgagggaatggattttgacaccatggatatagatttggtaagaaacttaatgatttctgtaagattttcagtttagatcttttgaaaattatgttggatatttattagagtagagaaatacttaccaagagaagtaagttttgcaaaaatattaaaatagttgccaggggtttagatatatgggaagggatttagaagagagtaaggttggtgaaggtggtagatcctagattaagatgataacaattgtctgtttgtttctgagattaatttaggaatatataggtttaaagggtatattttgattaatactaatttgactatgaaaatcaatttttatttaattatgcattttaaaaaatatgagttagtataaaagtataccattatcaaaacaatatattaatactacttgttgagacaaattccgtatcagataatgaagtaaaattacttaaacttggaaggaaattaaatacaggtaggagtgtattctttattaataattaaatatgtggttagggttgatcatatacaaaatggttttacatatttcatcttgctacatatctcattaaactttgtgaagtaggttgaaaggattgaggatattgaagcttactctctccaaagaggcaaaactagcaaacagtaaagttgatacttataagtccagtcttatgattctttttagtatattgtgtattcttcttaaataattaaatttttagaatggtataatttggtgcctcgaaaggaatatgatttttaaagtaaaatgaaaagtgagttttccggtttttgtctcttaggataattttccatgagttttttttttgagatggagtcttgctctgttgcccagacttcagtgcagtggcacaatctcagctcactgcaagctccacctcctgggttcacgccattctcctccctcagcctcccgagtagctgggactgcaggcgcccgcaaccacgcccggataattttttgtatttttagtagaggccgggtttcaccgtgttagccaggatggtctcgatctcctgacctcgtgatccacccgcctcggcctcccaaagtgctgggattacaggcgtgagccaccgcacccggctgataattttccatgagtttttaaaatattgtgtcaggtacacttggaatcacatagaccatgtgaagaacttggatattttcagttactatctggtttgtagatatagctaaactaatgtcaacttatttccttttttcctttagccaccatcaaagaacagacgagagagaacagaactgaagcctgatttctttgatccagcttcaattatggatgaatcagtaggtttaatttaaatgtaccctaggattgcaaaatcagaagtataggcagtctctcagtttgaggttgaagacctggggcagcatactgagaatagatgaaaacagctggatgtgagaaaaagaggcaggcaggcaggatttcagtgggaggggaagagagtgctgcaatagtgttgacagattagaaaagtacttttgaatcctggctgactgggacttgaatattaaggaatttggactgttcttccaggtttgtactgttcttcaatgggttgcccattgaaagattttaaataaggtaatggcatgatcagaattgtgtttcagaaagatttccttgacatttatggatgggacaggatgaatgaggggcgtcatataaaggcatggtgaaaaataatgagaacttgaacaaaggctttgataatgaagagaagggtatctagctatctaggatgagagtcagttaccactcccaccatccttaattggttattattgggttttgtcagttatttttcttaagtacctcttatatcagtcccctgtgccatattctccttgacagtgccttgattcgggtcctcctcagttttcacatgggctgttgcaaagcctttaagctgatattgcagtcccgctgctcctttatgcctcttgtggggtcatctttctaaaaatgcagatctgatattctcacttatcgttctaagtcttttattgatttttttcccccccattgccattaggaagaaaattctagctcctcagcctagcaaacaaagccttttatgatctggttcccttgccatcttaaccttggccttttccttacatgtattctatgctctagccatatcaaatcttgtagttccactcagatacactatgctctttcctgactccataactttgtataagcttttttctgccagaaattcccctttatttttcctcctagtaaagtctttctttgatactaattctgacattacctgtggaatttttgctgacttccacagatttttttttctctccttctttaactgtttgtacacactttattgtaataattaccagacttgtgtagtgagataggatattacatgccctggtccttcactagactgaactccctgaggcagtgatgatgttattcattcttagttctgcccagcacaatagatatttagttttgtcaaatgaataaatcatttaaatgccctgccatctccctttttagaatctacccattttatgttccttgttcctcacacctactgcctcaggtgacggttataccatcctcaaaggcctgccttctatgtacaatttctaccattcccaccttgccctctcctacctcataatctgctttcagatagcttttagaactattttgacaaactaattcacactaacatgtttactaataaggccaaggggccgggctcagtggctcatgcctgtaatcccaatactttggaaggccaaggtgggaggattgtttgagcccaagagcttgagaccagcttgggcaacacagtgagaccccatctttacaaaaactaaaaaaattagctgggcatgaagatgcatacctgcggtcccagctactcaggagggcgaggtgggaggattgcttgagcccaggaggttgaggctgcagtgagctgtgttcacaatactgcactccagcctgggtgacagagccgagaccctgtctcaaaaaaaaaaaaaaaaaaaaaaaaagtagaatctgcttcaattggtcttaagtgtggcctgagattctgcactgctaacaaatgctgtcagtgcttcaggtctgcaaaccatactttgagtagcaagactttatagtacctaatgacctgttgcactcataagtctatagtttaactgcacactgaagtttatggttttcttgataattaatctaacagtatgtatcatcttagtttgttaaataaaacatggaggtagtgattgtgatgaggggtaaaggaatattttcaagcaggtgcgatgaaatgcatttattcaacaatttattacatcagaagttggtgctaaagcgaataagacactccctgtccttaaggaattcatattctagtgcaccttgactatcactttgaaatgaaaagtatggaaggtagtagctgagagtttgggtgacagacactgtgctaggtatgatttattttgatcctctcagcaaccgtgtgagaaaggtaatgggaatttccactttcataccatagcaagctgagactgaagagatcatttagtgactttgctcagttatacagttagcaagtgtccgagtagtaatttgatgccagttccttttgatttaataatctcatgctgtcttctactgttgtgcttcccaaaactaaaatccccatttggatgagaacaccaacaaaagtaattaagaaatcgaaatggttaactgtgatcaaaattaatatgggcagttaggatcaccattttttaatgtatttgtctaatgtcaggagaacttttaacattcgttttcttagttacatactagatttgcaaaaaggtgttcttcagattactaaaataatgaaacagcaatattaactatgtgtatctatttttgacatttaacatttagagaaaaataggggcctaatagtcattttttatttatagtgattttatagcattctcatgtatattgaatgttacaactgaggggcttttatttattcttaatttgataatagtttagctgcttctgctacaaaaattaggaaaattagcacatgtacttataactgtagttttatagcattaccacatgatggcagcagtcacataactgaatgctcagtaatctttaaaggcttaggtgtctttagaagtctttgaccatgtaattttttttttaaagttaacagtttattttttaaatatacactaaactatactccatactgtcttaaccataacttaagaaatggaataatggaaaattttgaatgtcaaattctgtttgcctttatacaataccccacatctgttcttactgaagcccataataccggagtcatctaaacagtagcaaaattgggatttaaattctttaatgtccagttctgagattctccaattctaagggaagtaactcaaagcaccctaatgtagacacttcagtttgttactaaataaattgtaaaaatatctttttaaacacttaatttttaaacatgattttctaaataaatcataaaaaatatctttttaaacacttaatttttaaacaagattttctaaataaatcgtaaaaatatctttttaaacatgattttcacattatccaggagtggtaatataaaaactctgaacatattttgtgttgcatatacataaaattctagatttatggtgtagctggttttatatttggacacaaaattggtttataccattttgataacagttgttttctgccagaattgccaaaatacactgaagtttgatattaaatatgtttaagtatttattaatgttaacatcagaaacaggcagagtttgtgttggcacagaaaagaaagtgtcactactctcattctcttgtgttgagattctcttattagaattatttatagtataaaattggtaaagaagggctccatgtaatggagctaatttaatgttctagtaagagaatctacttataacctagtctgtacaaaacaaaaagaatctcaagtgtttgggtgctttctagtcaggcactctgtttggaaagaacttgagttcgtcttcatcccatactcaatactaaattgctaattaagattttgtactttcattcatcatcagaccttttctaccgagattcatagagtgttatggtaagaattggcctttaaacattatctcggtctttttggtggaaacgttctaaccacccaaactctgacttgaaccaaaaaaggagaaccctgaagcatgcgggaaggggagaggacaagggattagtagtgtggtagttactgtgaatggacaggtaagaaattgggtgcacgagtcctctttgttttcattacttgggattccaaacactacttgataattcattataaagaggctgcaatcagatacttgtttctggatctgcaaatacacagtttcttcagctcaaaacaatacatgagttctatgacttttgttcatagaacttataagagatttaacttacaagtaagagctctttgtaatatttcagctcattacatctggctttgatatcagttcttaatagcttattatagtattctaaaatattacttaatgggcataagtgctagaattttaattgaacaacctaacttttagtatatatactaagagtcacatgccattcttgtttagtgaacaagggagagttgctccattcatcatctgcttttacttttagacaagtaattattagattttacctaacattcctttctcagttggagtatatagaaagcatcaatgtaagtcattttgcccagattttaccttacccttttgatttcttaaaatttgtagttctgttccattcactttggccagattttctaaagaaagcttcttgctttctacatacttgaattgttcttagattttttttggtctgcatactcaaatgcctttttgaaaaaccatatccacttcccagcacaaatagccaagtttgcaagactttcttaacccctttccaaggaacctgtgccagaaatatatgtgaagaagcacattcatttattcatttaacaaatacctatgttgagtgcctatgtttagggtattatctagacattagtggtacatataagcataattaatccaaggttcctactttaattatatgtgaggtaagtagcatcttgattagtcctgatgttatttcattatatatcatggtcaatttaattttagaattatacatctgaagagaggggaagttttcaaagtggttttattagcatgttatttaacataataaagtattaatgtaatatttatggatatatttaaagaaatgaatgacttttaacgagattttctcccctctctctctctcattaggttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatccctaattggattattactttaaaataggaacctgtaaccattattgctttaattttcatctggtatgagttaaacacatttacaaatgtttacattgtttatacagggtacatttgagtgcctactgtgtgctagcatgtgttaagagatctctccttcatagatccattggggaaaacaaaataatgaaacttgtaataaatgccaggaaggaaacaagcaggatatgctgaggtagagaatgagagagagacagtaagagagaaacctgccttaaataaggggctcatggcatggaggtaaaaccatttgaaaaagaatttactaattgaattcttattgaaaactcatcaaagaaagtgttaagatttgcattgtactctttaagagattcatgtcagtgtaacactagcacattgttcatttgggctagtttgtatatcagaattgtcttctgtcattagtgattcagaactgaacatataaaatgatagctaaaacagctgcgtgctgttttaagtagtttacatgtaataactcattaagcctcatgacaagagttgataatgctgtcattcccccaccctctgccaccaatttttttttttttttttaacaaatcagaagaaggtgagaatgaggtacaaagaagtttaaataccttagaccaggggtaccagaacgtggcctgttagggactgggccgcacagcaggaggtgagtggcagcctagtgagcaagcattaaccacctgagctttcctactgtcagagcagccgtggcattagattctcataggagcgcgaaccctaaagtgaactgcacgtgcaaaggatctaggttgagcattccttatgagaatgcttgatgatctgaggtgcaacagtttcatcctgagccccccttcccaccctgcccccaaagtctatggaaaaaattatattccatgaaactggccgctggtgccaggaaggttggatactgataccttagacaaggttatatggctagtaaataatggagttggtattccagcccaggcagtctggctgcattaagtcctagaaagcattgaaactatttgatagataagggaaatattcataattgcatacacataaaatggtacattgttcattgtgccatagtgcatctatctacttagagttcagctggttatagagttggtaggtgtaaataaataattgtccttaatatgctacctaaccggctttcataaagaagatgtaagttgaatctgagtcctgagcttatcagtggtttagttaataaagctgagagactggggaagatgagtaggaaaattgaaatgtcttcaatattctgccacaaagggaactttaaggggtcacgtggttgaatacagatcagacagactattctggtggctgtaatgatccagcaaaagaaaatgattcgataaagcaccatgcctttggttatgaggaaactcggtgttgaagtccactaaataaatgtcacttcaggtcaacaaattattgattgatgtgtgcctggcctagtgctagctggtgagaaggcaaagaccaacaagacaggttttgtgcttacagttctgctgggggttaggatgcaggtgccaaaagaataaaatgaagtaagttcagtgtttttactgtgtgttaggggagcacagacgaggggcgcaaacagtggatgtgctcagggagccttcctataaggctgatgctagaattctcccctgcaacatttttatttatttattttttattatacttttaagttttagggtacatgtgcacaatgtgcaggtttgttacatatgtatacatgtgccatgttggcatgctgcacccattaactcgtcatttaacattaggtgtatctcctaatgctatcccaccccacaacaggccccggtgtgtgatgttccctttcctgtgtccacgtgttctcattgttccaattcccacctatgagtgagaacatgcagtgtttggttttttgtccttgcgatagtttgctgagaatgatggtttccagttttattcatgtccctacaaaggacatgaactcatcattttttatggctgcatagtattccatggtgtatatgtgccacattttcttagtccagtctatcattgttggacatttgggttgtttccaagtctttgcgattgtgaatagtgccgcaataaacatacgtgtgcatgtgtctttatagcagcatgatttataatcttttggtatatacccagtaatgggacggctgggtcaaatggtatttctagttctagatccctgaggaatcgccacactgacttccacaatggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctggtggccagtgatgagcattttttcatgtgttttttggctgcaaaaatgtcttcttttgagaagtgtctgttcacatccttcgcccactttttgatggggttgtttgtttttttcttgtaaatttgagttctttgtagattctggatattagccctttgtcagatgagtagattgcaaaaattttctcccattttgtaggttgcctgtttactctgatggtagtttcttttgctgtgcagaagctcttgagtttaattagatcccatttgtcaattttggcttttgttgccattgcttttggtgttttagacatgaagtccttgcccatgcctatgtcctgaatagtattgcctaggttttctaatagggtttttatggttttaggtctaagatttaagtctttaatccctctcgaattaatttttgtataaggtataaggaagggatccagtttcagctttctacatatggctagccagttttcccaacaccatttattaaatagggaatcttttccccattgcttatttttgtcaggtttgtcaaagatcagatagttgtagatgtgtggtattatttctgagggctctgttctgttccattggtctatatttctgttttggtaccagtaccatgctgttttggttactgtatccttgtatagtttgaagtcaggtagcgtgatgcctccagctttgttcttttggcttaggattgacttgacaatgctggctcttttttggtcccatatgaactttaaagtagttttttccaattgtgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggaattcactcatgatttgcctctctgtttgtctgttattggtgtataagaatgcttgtcatttttgtacattgattttgtatcctgagactttgctgaagttgcttatcagcttaaggagattttgggctgagactatggggttatctagatatacaatcatgtcatctgcaaacagggacaatttgacttcctcttttcctaattgaataccctttatttccttctcctgcctaattgccctggccagaacttccaacgctatgtggaataggagtggtgagagagggcatccctgtcttgtgccagttttcaaagggaatgcttccagtttttgcccattcagtatgatattggctgtgggtttgtcatatatggctcttattattttgagatacgtcccatcaatacctactttattgagagtttttagcatgaagagttgttgaattttgccaaaggcctttactgcatctattgagataatcatatggtttttgtctttggttctgtttatatgctggattacatttattgatttgcgtatgttgaaccagacttgcatcccaggggtgaagcccacttgatcatggtggataagctttttgatgtgctgctggattccgtttgccagtattttattgaggatctttgcattgatgttcatcagggatatgggtctaaaattctcttttttggttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgcacagaggtgtttgtagtattctctgatgatagtttctatttctgtgggatcggtggtgatatcccctttatcattttttattgtgtctatttgattcttctctcttttcttctttattagtcttgctagcggtctatcaattttgttgatcttttcaaaaaaccagctcctggattcattgattttttgaagggtttttttgtgtctctatttccttcagttctgctctgatcttagttatttcttgccttctgctagcttttgaatgtgtttgctgttgcttctctagttcttttaattgtgatgttagggtgtcaattttagatctttcctgctttctcttgtgggcatttagtgctataaatttccctctacacactgctttgaaagtgtcccagagattctggtatgttgtgtctttgttctcgttggtttcaaagaacatctttatttctgccttcattttgttatgtacccagtagtcattcaggagcaggtgttcagtttccatgtagttgagcagttttgagtgagtttcttaatcctgagatctagtttgattgcactgtggtctcagagacagtttgttgtgatttctgttttacatttgctgaggagtgctttactttcaactatgtggtcaattttggaatagatgtggtgtggtgccgaaaagaatgtatattctgttgatttggggtggagagttctgtagatgtctattaggtccgcttggtgcagagctgagttcaattcctggatatccttgttaactttctgtctcgttgatctgtccaatgttgacagtggggtgttaaagtctctcattataattgtgtgggagtctaagtctctttgtaagtctctaaggacttgctttgtgaatctgggtgttcctgtattgggtgcgtatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtgtctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcaatggtctttacaatttagcatgattttgcagtggctggtaccggttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaacgttgaatatcagcccctactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatattggcctgccttgctagattggggaagttctcctggataatatcctgcagagtgttttccaacttggttgcattctccccatcactttcaggtacaccaatcagacgtagatttggtcttttcacatagtcccatatttcctggaggctttgttcatttctttttattcttttttctctaaacttctcttctcgcttcatttcattcatttgatcttccatcactgataccctttcttccagttgatcgaatcggctactgaggcttgtgcattcgtcacatagttctcgtgctgtggttttcagctccagcaggtcctttaaggacttctctgcattgattattctagttagccattcgtctaatcttttctcaaggtttttaacttctttttgatgggttcgaacttcctcctttaccttggagtagtttgatcgtctgaagccttcttctctcaactcatcaaagtcattctccgtccagctttgttgcgttgctggcgaggagctgcattcctttggaggaggagaggtgctctgatttttagaatttctagtttttctgctctgttttttccccatctttgtggtttttatctacctttggtttttgatgatggtgacgtacagatggggttttgttgtggatgacatttctgtttgttagttttccttctaacagtcaggaccctcagctgcaggtctgttggagtttgctggaggtccactccagaccctgtttgcctgggtatcagcagcagaggctgcagaatggcggatattggtgaatttgcctgatcgttcctctggaagttttgtctcagaggaatacccggccgtgtgaggtgtcagtctacccctactagggggtgcctcccagttagggtacttggggggtcagggacccacttgaggaggcagtctgtccgttctccgatcccaagctgcgtgctgggagaaccactactctctttgaagctgtcagacagggacatttaagtctgcagaggtttctgctgccttttgtttggctatgccctgcccccagaggtggagtctacagaggcaggcaggcctccttgagctgtggtgggctccacccagttcaagcttcccagccactctgtttacctactcaaggggcaatggcgggcacccctcccccagcctcgctgccgccttgcagtttgatctcagactgctgtgctagcaatgagcgaggctctgtgggcataggaccctctgagccatgcgcgggatataatctcctggtgtgccgtttgctaagaccattggaaaagcacagtattagggtgggagtgacctgattttccaggtgccatctgtcacccctttctttgactaggaaaggtcattccctgaccccttgcgcttcccaggtgaggcgatgcctcgccctgcttcagctcactcttggtgcactgcacccactgtcctgcactcactgttcgacactccccagtgagatgaacccggtacctcagttggaaatacagaaatcacccgtcttctgtgtcgctcacgctgggagctgtagagtggagctgttcctatttggccatcttggttccaccccctacccctgcaacattttatgcaaattttcacacaacaaggttgaaagaattttactttgaatacactgttgtacttgcctttaccacatatccatctgtctctcatttatgtatttcaaagtaaattgcaaacaccggcacactacctcctaactacttcagtgtgcatatcattaaaagtttactgttttctattttggtgtataatttatatatagcgaatacacaaactatatatatttgctgttttgacaaatgcttacactgcttaacccaaatctgtatttgaacattaccatcaacctagaaagtttatttattctccttaaccaatctgttcatctatcctctagaaacaatagctattatgtttccatcatagactaaatttggctcttctagaacttcatataagtggaatcataacagtatttttgtgcaaggtttctttcagcatgtttttgagatgtatccatgtttcatatatcaacaattcattctttttaatgtgtttcattgtaaagatatactacaatttgttatgggttgtttctgcttttttggctattatgaataaagctgctacctgagttgcattttaaaagccaagaggtggaataggagaaaggaggactgggtgacgagggctgaaaatttcaggcaaaggagacaacataaatgaccatcttagatgtgagaactatttagtaattgcttaagggtggatggggcaagactggaaaggatagttgactatccaatacctcatcagctttaaaaatgaaaaaagacattcacaagtgatacctttggtaactgaagtgttttcgttttatgtgtgatgtgctcagaattggcgaagatccaaaatagtagcagggtgcctttaaatgacttgtgagaaattgatttaataatatgggtgttttcatcacatcaggccttattctaccattgaggaaaatgaaaggccagctactataagtttgtttttcattttttatttttacttgttttaattgactatatatatatgtgtgtgtgtgtacatattgacaagaactattcatgtgtatgtgttttaaaatatgtatacattgtggaatggctaaatcaagctaactaacatgcattacctcacattttttgtggagaggggtcttttgctcttactgtattgtgtattctcccttcaaatttattaatatttgccatatatatacttaggtgctccaatgttggatacatctatatttacaattgttatatcctcatgatgaatcgtcccctttatcattatataatgaccttctttgtgtctttttacagattttactcaaattctgttttatctaaagtatagctacccctgctctcttcaggttttcacttgtgtaaaatagatttttccatcccttcactatctgtgtgtgtccttaaaggtgaagtgagtttcttttaggcagtatatagttaggttttactttttaaaaatccattcaaccagttttttgattggagaatttattccatttatactcatagtaattattgataggtaaggacttattactgctattttgttcattgttttctggttgtttcatagatgctttgctcctttcttcctctcttgctaccttccttagtcattaggtgattttcttcagtgatatttttattccttactttatatcttttgtgtatcttctatagctttttgctttgtggttactatgaggtttacataaaacattttacaattacaacaggctatgttaagctgataacaagttaattttgattgcattaaaaaactatacttttactccccccattttatgtttttgaaggcagaatttacatctttttatattgtacattctttaacacattattgtagctattattactattattgttttttttttttttttgaggcagtgtttcactcttgttgcccaggctggagtgcaatggtgccatctcagctcaccgcaacctctgcctcccagattcaagcgattctcctgcctcagcctccccagtagctgggattacaggcacgcaccaccatgcctggcaaattttgtatttttagtagaggtggggtttctctatgttggccaggtggtctcgaactcccaaccttaggtaatctgcccatttcggcctcccaaagtgctgggattacaggcgtgagccactgtgcccggccctattatttttaataattttatcttctaaccgtcatagtaaagatataattgatttacacactatcattacagtattagagtattctgaatttgtatatttacttttaccagtgagttttatacttttatatgtttttgtgttactaattagcattatcttttatcttgaagaactcccgttagcattccttgttagacaagtctggtggtaatgaactcgctcagcttttgtttgtctggaaaagtcttatctctccttcatttctcagggacagctttgccaggaacatgttcgtggttagcaggtttttcctttagcactttgaatataatcatctcactttctcctggcctgtaaggtttctgctaagaaattcactgctgactttactggacctcccttatatgtgatatgcatttttttctcttgctgctttcattatctgcgctttgtcttatttttgacagtgtgattataatatgtcttggtgtagtcttatttggattgaatttgatttcagatctttgaccttcctttacatggtatttatatgttttctcaggtttagaaagctttttgcaattattttcgtaagtaagctttctgttctgttgtctctgtcttctacttgaacacctataatttatataatgctcttttgatcctgtaccataaatcctgtaagctttcttcacttctttttattcttttttcttttttctctgactttatattttcaaatagactgtcttcaagttcacatatttgtctgcttcattaattctgccactcgctatttcattttattcactatatttttcagttccagaatttttttcttaaatttcaattcctgttaaatttcttgtttattcttttcctaattttgttgagttgtttctttgtatttcttgaagttcaatcaacttccttaaaacaattattttaaagtttttggctggcagttcataaatctccatttctttaggttcacttcctggtgctttcctttgttcctttgatggtgtcatgttcccctgattgttctttatccttacggctgtgcgttggtttctgtgcaatttgaagaagttggaacttatttcagcctttgtagactggctttgtcttggaaagcccttccacattcagcctgtccagagattcttagcaggtagtctgatgtggtctatgagtgggcttgctgctggtgtccttaggcaggctggccaggtagctgggtaaggaagtgagtgggcccagcacctgggtccacagggtggggccttgagcctcagttttcaggggctggccaggcattagaatgggtctggaatctaagtccataggagcagtgctatagcctgagtccatgggggctggctcagtgctaggctctattgggatgaacctggaccctgggtctgctggaggatggggctgcagtggctggcctggcattgtgcaagcctggaacttgtgtccacaggtgctgtcctggtgcctgaagccaggattgtcaacctggcgattggaccagggattccagcctgatgagtagggctaagggtgggggcagcctagtgctggggtgggcctgaagcctgtggctgtggaggtggtccagaatctgaggctgctcggatggacctgtctataggggctggcttgatgctagggttggcccagagaccaaatccatggggcaggcctggagcctggggctacagggtctggcctagcactggggcaagtctggaggctcagtttggggatactggcctagagtttggggccatgggggcacaggattttactgggatgggcccagtgttggttttactgggatggacaaagtctggtgctcacttccctcttcccccaagcggagggtctctgtccacactgctgactgggattgaggaaggggttatgaggataatataaaactgtccttcctaccatcttcaatgtagtttttcttatttctgcattaaactcaggtgctataagctctcatctggtttctttagctcttgagaaggtatttttgtgtgaggatagttgttcaaattgatgttcctgtgaggagccaagcactggaaagttctattgtgctttcttgctcacatctgaactcgtaccttgattcttttttacattaacttatttatcctctactatcttttgctgagtatatgcctgaggattttactctagtgaacctgtgacaagttagcttttaaacaattttatagtgtttatagcaaaattgtaactaacattgaaaaaataatagctaatatgtgttgtgtttactgtataacaagcactattctccagcaaattatagttgatattatccgcattttacagagaaggaaactgatgcacaggttaaatcaacttgccgaaggatgcgtaacatgtaagtgatgaggtctagattttaactcacggtttctgattccgcaggctatgaatgtaactttctctcttcatcctcctgctactaaatgtatgcacctacttgtgtctgtctttattcgtatagtttgtgtttcattctgttatagtggacaagctatccttgtttctaagatactggatcctatcctgtatttttctcctctctcccctcccctctcttattctttttattggagaatggtatttagaagccagaatttggcaactacatatgctcattggtactggttttaattgcttctacaggctttcttagaggacaaagctgagaaatatatgtatgtatacatatgcatacttctatatgtatttatctgtctgtatgttctgtgctacctccttcactgccactacctccacaatgtagttatgttattcatttgacatatagttaggtttgtttatattgcatcttagggtcctcccccatttttgttgattttatttatttatgaatatgtgaggaattattaacaagattctaaaagccaaaactatacagaaatatatactcaaagaagtctcactcccacccttgattctttctatcccattcctagcctccattctttttttttttttttttatgagatggagtttcgctcttgttgcccaggctggagtgcaatggcatgatctcggctcactgcaacctctgcctcccgggttcaagcgactctcttgcctcagcctcccaagtagctgggattacaggcatgtgccaccacgcctggctaatttttttttttttgtatttttagtagagacaaggtttcaccatgttggtcatgttggtcttgaactcctgacctcaggtgatccacccgccttggcctcccaaagtgctgggactacaggcatgacccatggtgcccggcctgctagcctccattctttccatcctatttccactcaccacctgtaggtaaccaatctctttacttcctgcttaacattttctgtgtttcttcctgcacaatgagcagatatgtgtacattttcttattttccctttattactcttttgcactcattttattttattgtagagatggggtcttgctatgttgcccaggctggtctgaaactcttggcctcaaaggacctttctgcctcagccacccaaagtgctgagattacaggcaggagccaccacgcctggcctgcattctacttttcttaaaacttaacatgtcctagaaatcatttcatattattcatagattcttattctgtttttgcagttcatactacttcattgtgtgggtacactatagtttaaccactcttctatgtatgggcatttaggttgttttcattgttttgtatctacaaaggaaatactgcactgaataactgtgtgtataggtatttttgtattgttgaagatataacttcggggcaaattccaatgttcttcaaatggctatgtgtgtggatttctgttagatactgccaaattctcccccctaaaaggattggctaatttttctatttttagtagagacagggtttcactatgttggccagtctggtctcaaactcttgaccttgtgatctgcccacctcagcctcccaaagtgctaggattacaggcgtgagccaccatgcctggctttttttttttttctatgttttgttttgattttgagacagcatctcactctgtcacccagcctggagtgcagtggcagaatcacagcttactgcatcctcaacctccggagcttaagtgatcctcctaccttggcctcccaaggtcctgggattacaggcgtgagccacccttgcccagcttctcctcaatttttaagagttctttagatattagaaatatttgccctttgtgatacatgttgcaaatattttccttgagtttgtcattgtctttgactttgcttatgctatttttctgccatgcaaaagattttaaaaacctttatgtggtcaaatgtgttaactttttatttcatcaggactttgagtcatagttagaaacccaggttatacaggaattcacccaaattttcttgtaggacttatatggttatatcatttaatttctttattcagatttctaatccatttgaaattgattcttgtgtaaggtgtgaggtatgaatctaattttatctttttccaaatggctatccagccctgtttattaaaatggtcatctttgccccagtggtttgagctgtcacccttatcagacagtaaatttccctatgtacttagcatacatctctggactttcttttctgtttcacttgtcagcctgtctattcatgcagggagtaccacactgttttgtttgtaaggctttttagtcggctttaacattccatttattatttcctttttcagtgttttgcaagctattgttgcatgcttattatatggaaagtgtcaacttgtctagctccattaaaaaccttgttagtattttattaggattgtgttaaatttaaaaattaacttggccagaaattgtgactcatgcctacaatcccagcactttgggaggctgaggtgggaagatcacttgggcccagaaattcgagactagactgggtaacataaggagaccccgtctctactagataggtagacagacagacacacagatatgaacaaaaaattaactacaggaggactgatatctcctcctcatcagtccttgcaaaggtgagttgttctagttaagaacagggatatctttccatttgttcaaatctactttgtgtctttcagaagtgttttaaacttttcctcaaataggttttgcacatttcttaagtttattttatcttcattattgctatttgaaggtggttttcctctaccattatcttctctaactggttttagtgtacatgaaggctattgatttctgtatcttaattttatatattgctagcttactgagtaaaatagtgttggaaaaactggataacgatatgaaaaaaaaattcagctcaactcctatctcacactatacataaagtcagtttgaggcagattatagatctgtcaccacagtttgtgccccgagttcttggctttcgtgtaaatggaaattaacgccaggatggggctgggtgtggtggctcgacggtagtcccagcactttgggaggccgaggtgggcggatcgcgtgaggtcaagagtttgagaccagcctggccaacatggtgaaaccccatctctactaaaaatacaaaaattagccaggcgtggtggcacgtgcctgaagtcccagctactcgggtggctgaggagggaggatcccttgagcccaggaggcggaagttgcagtgagctgagatcgcaccactcctctccagcctgggggacagaggaagactctgtctcaaaaacaaaaacaaaacccagaaattaacaccaggccaaacaaatttttcacagataaggtataataggcttgtggctcaagcaaagcaagtgagcagcgtacaggaaaggggtcccagtgctagctccctgaagggctttagctcttgccattttaaggaagctgaggtgaaaaagggtgatatataggcatgtactacctgcacagtttgataatatgcttcttcatgtattgtgtgtctcattagctgttaaatctccaccccgggtgtgatttttagcattataatgagattattaggaggaagaccttgatgaaaggtcagcgctggagtctatcttgtctagctgggtgcatctggtcaggttcttatcaggaatgctagagtctcactttaatagccttgggagaagtaactcaaggaaataaacggttacgttctttttttttttatggttgggaattcagaggaggcagcagctatctgctacgtgacttgggtcaaccctttaagggaggcaagaaggtagaggaaggcatatgcctgggcatgtgaggaccctggggttttggttaccatgtctcttccctgccagactgagtctcttcgctatgttgtcccaaatctaaatgtaaaagacaaaattataatacttttagaagaaaacataggagaatatgtttgtgatttgacagtaggcaaaaaatttcttaggatgtaaataactatcaaagaaaaacctgataaaatagacttcatcaatggccgggcatggtggctcaggcctgtaatcccagcactttgggaggccgaggcaggtggatcacttgaggtcaggagttcaagaacagcctggccaacatggtgaaaccccatctctaccaaaaatacaaaaatattagctggcctggtggtgcaggcctgtagtcccggctactcaggaggctgaggcaggaggatcgcttgagcctgggaaacggaagttgcaatgagctgagattctgccactgcactccagcctgggcgacggagcaagattctctctcaaaaaacaagaaaacgaaaacaaaacatcaaaatttaaaacttctgccaaagaaatgacaccattaagaaaatatataggcaagccatagactggaagaaaatattcacaaaacatttatctgaaaaaggactggtatccaggatatataaagaactcctgacaactcagtgaaataaatacccaataaaatgggcaaaagatttgaacataacactttacaatagaagatagatgagtaggcagggtgcggtggctcacgcctgtaatcccagcactttgggaggtcgaggtgggtggatcacctgaggtcaggagttcgagaccagcctgaccaacatggtgaaaccacatctcgactaaaaatgcaaaaattagctgggcatggtggcacatgcctgtaatcccagctactcaggaggctgaggcaggagaatcacttgaacctgggaggtggaggctgcaatgagtcaagatcccgccactatactccagcctgggcgacagagtgagacggtgtctcaagttaaaaaaaaaaaaaaaaaacatagatgagtagacaataaacacttgaaaaacatgttcaacagcattagttataaaggaaatgaaaattcaaaatcacagacatactactacacatctaccagaatgactaaaatttaaaaagacagacaatacaagatattggtgaggatgtggaacaagtgaaattcacattttgttttggaaaagggctggccatttcttaataagctaaacactcacataccccgtgatccagcaattcctttcttaggtgtttacccaagataaattaaagtccacaaaaagacttgtgcaagaatgttcatagcagctttattgatagtagttccaaatgggaaatagcccaagttttatcaacagaaaaatggataaatgaacctaagtatatttatacagtggaatacaactcagcaatgaaaaggaatgaactaccaatccacacaacgaggaggacaaatatcaacattatactaaaagaatccagatataaaagtatacatactgtataatttcacttatatgaagttctaacacagatgaaactgttctgtggtggaaaaaatcctaacggtcattgtattaggagtgtagaggccaggattgacatgagaacatgagggaacttgctgtggtgatggtactatcctataacataagttttggcctatgtgactcaaacccttacacaaaagatttgtgcatttcacattatattttacctaataacaaaaaccataagtaaaagtttaactttagttgacatgtatactgaaatattttggtgtgaaatacactgatgtcttcaacttatctcaaaatgcatcaaaaataagattagtttatggatgagatgaatagatataggtgtagataaaatgttagttgtaaactccagaactccaggtggtgggtatatgaatgttaaccgtaaaatgctttcaacttctgtgtttaaaaatttccatatcaaaatattgaaagcaaaaaagtggatgggaggaggaggggagaaaggaacgaaaagaagaaaggaaagaaagaattacttacaagctaagaggatttgatctgtggaaacagacctttcaggctaacaatctgttcccgctaccaaataaatagactctgaggtgatcatacacagacagtatatggtggtttaggaagactagttaatttactattgtttaaaagatatttctaggtcctcgagccaggggggaaaatatgtattcttcacagctgtgctaaaaaaaagaaagaaaaaatatgtatagttgtaattagagagcttaaacaacaaccgcaacaagaacaaaagccttaaaaaaaaggaagcaaatcctgccattgtgacaaggatgaacctagaggatattatgctaagtgaaataagccaggcacagaaagacaaatactgcatgacctcactcatgtatggaatctaaaacagtcaaactcatagaaacagaaagtagaaagatggttgctatggtctgagagggagcagagaaatgggattttgatcaaagggtacaaacttttagtaataagatgaataagttccggagatcaaatgtgcagcatggtgagtatagttaataacgtatacttgaaatttactataagtcttaagtgttctcaccgcaaaacatgtaactatgtgaggtgatgatataggagttaagaaggaattacttaggcagatagcaagggcatgggagccctcggtaaggcttttctttttcatgaaaagcagccccaaatcattttctaacaaagagcagcctgtaaggtcaagccacagacataggcaaaccagctaagagcttgcaagggtgaatgccggcaggaactagttactagacatgttcaagagggcgggtccatcttcccttctctttgtcagccacgtgtacagtaaagagcagacaagatggatcaactggaaagcccatttgccataactttagagtgagctaaatcgccactaatgtttatccccattttgttaaaaaataatacaacaatgtaaaaagaagcaagatgaacaccaagaatgaaaaataatttgttacagcattcatgttgtctctgagcatataaaacaaaaccagtttttcagattaagcctaccacttatgggttgtcataaaatagtatcctggcaatggaagaaagaacctgacagtaagtaaaacttcatgtttctagtatttcttatgatatcccttagtataggccattagtgtaatgccaaagtggaattcattaaaggatagccaaaaagtggaaataaccaaaatatccatcaatgaatgaatgaatgaataaaatgtattatatctatgcaatggaacattagttaaccacacacaaaaaaatgaagtactcattcacgctacaacatgggtgaaacttgaaaactattatgcttagtgaaagaatgcagtcactacagagacccaaaagagattattgttctaggggatgagggtggtgttgaagaaaaaggggccacaattgctaatgggtatgtttttggaggggggtgacgaaaatgtttcaaagaataactgtggtgatgattgcacgaccctgaagatgtattaaaaaccactgtacatttaaaatagttgaaatctaaggtatgttggttatatcccaattaaaaaaagcaattctcggccaggtgtggtggctcacgcctgtaatcccagcactttgggaggctgaggcgggtggatcacctgaggtcaggaattcaagactagtctggccaacatggtgaaaccctgtctctactaaaaatacaaaaattagccagccatggtggcttgcacctgtagttccagctactcaggaggctgaggtaggagaatcacttgaatccgggaggtggaggtggcagtgagctgagatcgcaccactgcactccagcctgggtgacagagtgagactctgttaaaaaaaaaaatgcaattctccatagactaggagaaaatatctgcaaaaggcatttatgataaaggactgttataaaaaatatgtgatatgatttggatatttgtccctgcccaaatctcatgttgaattgtaatcctcaatgttggaggtggggcctgcttgggtcatgtgggcggatccctcatggcttggtgttatcttcatgacagtgagtgaattctcacgagatctggtggtttaaaagaagtgcggtacctctcccacacccgactctctctcgctcccattctcaccatgtgatttgcctgctccctttttgccttccataatgactggaagctttcggaggcctccccaaaagcatattctcctatgcttcctgtatagcctgcagaacttatgggccaattaaatctcttttcttacagattattcagtttcagttatttctttatagcaatgcaagagtggcctaatacagtaaacaaataactcttttttttttttttttttcttgtgacagagtctcactctgttacccgggctggagtacagtggtgcattctcggctcactgcaacctccgcttcctggtttcaagcaattttcctgctgggattacaagtgtgcaccaccacgctctgctaatttttatatttttggtagagaaggggtttcaccatgttggccatgctggtctcaaactcttaacctcaggtgatccgcccaccttggggtctccaagtgctgagattatagggatgaaccaccacgcccggccacaaagaactcttaaaactcaacaataagtaaatagcccactttaaaaactggccaaagtctttaacatacatattgctaaaaaagatatgcagatggtaaataagcacatgaaaagatggttcatattatatgtcatcagggaaatataaatctaagttaaaatgaccattacccgttagaatggccaaaatccagaacactgacaacaccaaatgttgatgaggatgtggagcaataggagctctcattcattgctggtgggaatgcaaaatggtacagcaactttgaaagacagcggctgtttcttacaaaactaaacatactcttaccatatgatgcatatggtaccaatatcaatcatggtccttggtatttactcaaaggaattgagaacttgcatccacacataaacctgcacatgtatgtttatttatagcacatttgttcccaattacaaaacttgaaagcaatcaagatgttcttcagaaggtgaatggacgaaatgtggtacatccagacaatggaatgtaaaattcaatgctaaaaagaaatgagctatcaggccatgaaaatacgtggaggaaccttaaacgcatatttctaagtgaaagaagccagtctgaaaaggctaaatactgtatcattccaactatatgacattctggagaaagcaaacctatggagacagttaaaaagattagtggttgcctagggttggtggagagggaaggatgaataggagaaacacagaggattgttagggcagtgaaactattctgtatgatactctaatggtggatacatgtggatacagttgtccaaacccatagaaagtacaacactaagtgttaccctaatgtaaactgtggactttgggcaatagtgatgtgttagtgtactagtgtatgttcatcaattgtaacaaacataccactcttgttggggatgttgataatgggaagggctgtgcttgtgtaggggcagggagtgtattggaaatctctataccctctttttttttttttttttttctgagatggagtttcactattgttacccaggctggagtgcaatggcatgatctcggctcactgcaacctctgcctccagagttcaaacgattctctggcctcagcctcccgagtagctgagattacaggcatgcaccaccatgcccggctaatttttgtatttttagcagagatggggtttcaccatgttggccaggctggtctcgaactcctgacctcaggtgatccaactgcctcggcctcccaaagtgctgggattacaggcatgagccacccccccccagcctctttaccctcctgtagattttgccatgattctaaaatttctttaaaaaatataaagtctttacacctaaagtaattttgtgtgtgtgtgtgtgtgtatgtgtaggggtaggcaagtcaattcagtccacaaatacagttttcttgatgatctcacttttatccagggatacatgtttgactagagaaatataggcttcttagacttcaggcgatcctctataagtattatatctctcagctgagctttccgttaagtattgagcaactgtgggtttgagggtatgttctctgacaaatccttagagcacaactattctgtgtttgccaaagcacagagccatgtgtcttaaaagtcaacccaaatgaaagatgagccaaacaggaatcagtccttgaattgaaagccactgcccttctgtgtggaggtaggccaagggaatattcactgtcagggccaatataactcttgggaagcaagttgtggtctgctttagcacagagatgaaccagacccctaaactctaaactagagatcatcaccatagtgattttaggcagcaaaaatttaaaacaagaacgaaatctcggtcctgaaaaagctcaggaaagatctagctttgaacagtgaaacttcctaatgagccagccaccaaagagaaactagtttaaaagatatgtctaagtaactgaatgaatcaatgtactgtacaggattgttattgccgaacttgataaatgttgaggaatgtctactcagaatggtgattttgatttttttttttccaagatggggtcttgctctgttgccaaggctgcagttcagtgttatagctcactgcagcctcaacctccggggctcatcctcccacctcagcctcccgagtagctgggactacaggcatgcaccaccaagcctgactaatttttgtgtttttagtagggatggggttttgccatgttacccagactggtctgaaactcctgacctcaagtgatccatccgcctcggcctcccaaagtgttgggattacaggcatgagcctccgcacccagcctgaagcttctcttttgtagctgtcatgcctagcttgtgacaaaccttctgctaatggggatagataaagcatctatcttcctacttcaaagtgatattaagttatgaaagtactgctcaatttcagcaagactttcacagcttaatatcactttgaagtagtagatagatgctttatttcagaatttcctcagaaattgaggaaaagccagtacacacaacttgttggctgaatcggaaaatgcccatcaggttaaatggagcatagtcctattgatgctgccattcttgtttaattggcaactaggagtgactgaaaatacatttaggcaaaaatgctaaatggtcaagtgttaaaatcaatatttacctgaagccaaggcctaaactaaataatgctgtcagaaaatttctggaatgcaacagtaaatccaaaattgtattgaaacattattaaatgtctttagtttaaaaatgaggttttcagctacacaaggtggctcacgcctataatccgaacactttggaaggctgaggcaggaggatcgcttgaggccaggagttcaaaactggctgcctgggcaacaaagcaagacactgtctctacaaaaatattttcaaaattatccaggtgtggtagcacagcctgtagtcccagtgatatgggagccgggcagggaagtgctgggtagagaagggtggggtccctggccaaggcctccacccttgggcctgtgcccatggacctgaatgaggacaggtatttctgttttcaagcccaaaaattgccttttggcccgccactgccccccgccccgacgcccgctggcatcctgtgcccataaaaacccgagacctagcgggcacagacacaagcagccagacattgtgaggagcagaggaacacaccagcagacacctgcagaccagcaacagtggaatggcgcagatgccgaggggatttccgcccagggcagttggagaagagtcccgccgctgggtggcccgactccaggggaagaccaccttcccactccattccttgattccggttcagcatccatctagccacctccaccactcaataaaaccttgcactctaccttccagcccacgtgtgatctgattcttccggtacactgggcaagaactcaggagagatagtgtcttgctttgttgcccaggcagccagttttgaactcctgtcacactcgccccatgtccttgcgataaggcagagggtctgctgagctgactaacccaagccatggaacacacgcccacttgggctttgggagtcctgctgtggggacagagcccaaaagcactcttcacggcctctgcacccgcttgtctgcatgctccccctaggggtttgagcagcagggcactgaataagggaaccacacctctgttgcatgccctgcaaggggaataagagaactctctcatttcaccagctagtccggaggctgaggcaggaggatcacttgagcccgggagttctaggctgcagggagctgtgactgtgtcactgcactccaacctgggcaacagagtgaggccttgtctcaaaaaaaaaaaaaaaaaaaaaagaagttttcacattgaacatttatttatttatttattttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgccgccttcaagcatctgtttaacaaagcccatcttgcaccgcccttaatccatttaaccctgagtggacacggcacatgtttcagagagcacagggttgggggtaaggttatagattaacaggataagaatttttcttaatacacaacaaaatgaaaagtctcccatgtctacctctttccacacagacgcagcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccgtcacctcccgtgcggggcggctggccgggcggggggctgacccccccacctccctcccggacggggcggctggccgggcgggggggctcctcacttcccagtagcggcagccgggcagaggcgcccctcacctcccggacggggcggctggccgggcggggggctgaccccccccacctccctcccggacggggcggctggccgggcggggggctgacccccccacctccctcccggacggggtggctgccgggcggagacgctcctcacttcccagacggggtggctgccgggcggaggggctcctcacttctcagacggggcggccgggcagagacgctcctcacctcccagacggggtcgcggccgggtagaggcgctcctcacatcccagacggggcggcggggcagagccgctccccacatctcagacgatgggcggccgggcagagacgctcctcacttcctagatgggatggcggccgggaagaggcgctcctcacttcctagatgggatggcagccgggcagagacgctcctcactttcgagactgggcagccaggcagaggggctcctcatgtcccagacgatgggtggccaggcagagacgctcctcacttcccagacggggtggcggccgggcagaggctgcaatctcggcactttgggaggccaaggcaggcggctgggagctgaacatttttattaataggtatattttttgagacagagtcttgttctgtcacccaggctggagtgcagtggcaagatcttggctcactgcagcctgtgcctctcaggtttaagtgattctcatcatgcctgagcctgtcgaatagccgggattacaggcgtctgccactacccatgctaacttttgtattttttgtggagacggggtttcaccatgttgcccaggctggtctggagctcctgacctcaagtgatccacccaccttggtctcccaaagtgctgggattacaggcatgagccatcgcgcccggccaatataacatacttttaaatgacatttttttttttggtgtataggtctctaaggagttcataaacaattttatggtgtcatttttctgaatttcccctctttccctctctgccatctttctgatactttcaggtttctaaggcttccatattcagtcctctgaccaggaaactggcatttttagttagttcattctgccatatattaatacttcttgtgactgtgcccatgtctggaaggaaagagacagagggaaatgaaccaatgggtgtttgctcccctgtcttgttaccacacctcctcagagttttaggcccctgagaggccctttgactgctgcagccactgctgctgtccatgctgtgataggattgcaagtttactttgaattcttgtcttcttttccaatatgtccgctaccacatactttatggagttctcaaatagatgctccatgcattctatccaggttttatagctgcattcagtgggagaggcagagtggaatgtgcttctacaacttaactagaaaaccagctcttgatgttttatacaatcttttgagagaaatttgtctttgaacagtggacctagatgtgttaatagagcaatgtaatagactcttaagatactggctggtcacggtggctcacgtctgtaatcccagcactttgggaggttgaggtgggcagatcactggaggtcgggagttcatgaccagcctggccaacatcgtgaaaccccgcctctactgaaaatacaaaaatcagctgggtgtggtggtgcacgcctgtaatcccagctactcaggaggctgaggcaggagaatctcttgaacccgggaggcagaggttgcagtgagccaagatgacaccactgcactccagcctgagtgacagagtgagactccatctcaaaaaaaaaaaaaaaaaaatctacgaattgccacctgtatcttagcattcattgcatgtatgcatctagtcaaattccggaagccgatttgcctagctcatctacagttgaccatagacgcatgaaggagcccagctaagactggaagaactgcccagctgagcccgaattaaactcacaacctgcagaattgttagccaaataaatggtgctttattaaaaccactaagtttttgggtggtttttaaaataacatagcaatagctaactgctactgtaagcaaagtacaacaaagcattaatccattgtgctgtgattttaaaaaagatttctggttgattttgcatttccaagggtacaatgaacaaagttttaaaagtagcatagctaatagtattgctaatcatttttgtgcacagtagaatataattcagacaaaacatttttcagtaatttaatttttagaaggaattttgtacctgagattcatagcttgggcacatttcaaaaatccttcaatttcaactactgaaaattgttggcagtctataagcatcatttcaacaagttttgtttagattcttaaactccatagactcaacacaataaggaattgccttaaaggattcctgtaaagtctgtttttttgaagcttgcttaatgagaatcaaatgagctttggttaccttacttgtctctaacactttcttgtctttatagtcattacgttctttgttactatatttggatgaaacatgatttatcatggctgttgcaagtgattttggatttttttcctcatgaacttctgaggcagaaaagttgacatttagcttttattttgtcttcataactatgaaggattttcaaataagactttttcttaaaacactcatggccttataattaaacaattaaaaattaaataaagttatttatttatttattttttgagacagagtctcactcagagtgcaatggcgtgatctcagctcactgcaacttccgcctcccgggttcaagcaattctcctgcctcagcctcccgaatagctgggattacaggcatgcgccaccacgccaggctaatttttgtatttttagtagggacagggttttgtcacgttggccaggctggtcttgaattcctgacctcaggtgatccaccagcctcggcctcccaaagtgctgggattactgacgtgagccactgccgccagccaataaaattcttaaaggctattttgtttattgttccaaatgccgatgcaaaaaaaaaattctacaaagattagaattatatctaatttttatttttgttttataatttaaaaaagtatttgctccaaaagaatatgattatcttaaatgtatttggctactgcatattaacctaatattttattttattttattcttggattttgagacagggtctcactctatggctcaggatggagtgcagtggtgcaatcatagctcactgtaacctcaaactcctgggctcaagtgatcttcccaccttagcctccggaatagctggaactacagatgtgtgccaccacacctggctaagtttaaaaaaaaactttggtagtctaaaactcctggcctcaagcaatcttcccattttgacccctcaaagtgctggggttacaggcatgagccacaatgtctggcccttaatatttgtattgactgttcacctatttccctatttattaataactttttgtaagttcctatgtttgtacataaaattactttcataatccccattaagtattgtagcatttaactcctgccataataaatatatatttatacttcaaatgactgaaacatttcgacatacaaggcatatagggaggtttttaccccagttgacctctagaatgcttacctatatttaaaatgcttagatattaaaaataaacctaaattatattctttgttcatattaccgacagtttggtattgattatatatgatgataacatataagatcacatcttgcaccagttctgggatggcagaagtaatgttgaggtagacatttggccttccaaaggataaggccaaaggtgagagcagattttgggcaaatattaaggccaaagctaactttctttacttttctctttctttctttcctttctttcctttctttcctttctctctttctctctttctttccttctttccttctgacagactctcgctctgtcacccgggctggagtgcagtggcacgatctcagctcactgcaacctccacctcccgggttcaagtgtttctcctgcctcagcctcctaagtagctgggattacaggcacccgccaccatgcccagctaatttttatatttttagtagagatggggtttcaccacgttggccaggctggtctcgatttcctggcctcaagtgatccagctgccttggcctacccaaagtgttggaattatgggcgtgggccaccgcgcctggctccaaagctaactttcaatgcatccctacagctgactcttactttctcccctgctccagaactgtcctagatgatgtgacttagaaagtgtctgggatgattttaatccataagagcacacagaggaacattataacatcctgcttcatttggcttcacttccacatagcatcccgtgccttcactaataccacccccacccctgccccagaagacataagtctcttccttttgtgagctgggtccttttaaaattactagggtgggcaagttaagtggagagtgcacctgcagtgaaaaaagggagataactgaaaaaagaaagactctttcatcttttttgtgatgactggattttcatgctgttatgtgagatgtgcctccctcaaaccttgtcatgacatcttggcacattacccatctgatgtgaaaaaaaaaaatggagggaaagaagttgaccaggagaccgaatataagaagagccagagaggaccatggttttctttagagaagaagaggctgcagaggtgaagcatcactggaatcattaaatgattgttggaggttatgcattgtttctaatttcccctaagtatagatgtaaaaattgcaggaaaccactcttggatggaagaaggtacattaaatgttggagaaagttgctgaggcaggatctcaagagtcgggtggaagaagaaccagtggagcaatgatgtcctcagaaaccagcaaacgtactaggcagactttccagttttaatgctctttatggtgttgtaaaaagtaagaacagcctttctctaacaagggatatcctgaacaagagatgggctgccctcaaatttctggttgtctattgctgattaaaaggaaggccagctaaacacaatgcagtatcctagattggatcctgcaatagaaaaaggacattagtggaaaaactagtgaaatctaagcctggagttttgaaaatgtaccaggataggccgggcgcggtggctcacacttgtaatcccagcactttgggaggccaaggctggtggatcacctgaggtcaggagttcaagaccagcctgaccaacatggtgaaaccccatctctactaaaagtacaaaaattagctgggcctggtggcacacgcctgtaatcccagctacttgggaggctgaggcaggagaatcgcttgaacccaggaggcagagattgcagtgagctgagatcgcaccactgcactccagcctgggcgacagagtgagactctttctcaaaaaaaaaaaaaaaaaaaaaaaaagaagaaagaaaaagaaagagagagagagaaagaaagaaagaaaaagaaagaaagaaaggaaagaaagaaagaaagaaaagaaagaaagaaagaaagaaagaaagaaagaaagaaagaaagaaagaaagaaagaaagaacgaaccaggataatataatgtgttaaccttggtgaaaactggatgggaatatgtgagaattctctgtactatctctgcaaattttctgcaaatctaaatttattccaaaagtgaaaaacaaacaaaaagaaaaaacctaaaactgagggaaaataagaaggcatgaatttgaaagcaggctagtgggtttttacagggaggcatttccttcagggctaggcagagcccccagagaaggttaaatgggaagaacgtaatgactactccaaatatggactagaaagtaaagtaatgaaacacaactgagggaaagtaagtagaggatagactcacatcaggatacttcgtgtaaattttgagaaaatgatgtcaatattaacatgtatattataatgagatagcaatggtctaatacaaactcattctctcatacagattatcctttagtgtttagccaatgttcgattcacatggaattgacatctgccacctttggtgagagttataaggaaccagatgttttttttttctcccttcctccatgcagatgtgaactgtggttaaacagtggttttggagtgagatggtccaatattttttcttaccatgttgtttcatagtttcaaattctgcattaaaaaattaaacagcttaaaaaatgaacaagtaaaattatatcaaactaaaaatcttccacataatgaactaaataatcaacaaaatgaaaaggctacccacagaatgggagaaaatacttgcaaactatatagctgataaaaggtactatggtcttaatgtttgtgtccccccagattcatatattgaagcctaatccccaatgtgacagtgtttccattagggcagagccctaatgaatggtattagtggccctataatgatattcccaaaattccttctgtatgtactccatgtgctttctcgattatcctattctagtgcaaccactttttgcaatactgaattatcaggcattaataccttagcatagatttgtttatctcatcctagagactggtaaatgttttactcatttatttatttattttagagacaggatctcactatgctgcccaggctggccctgaactcctgggctcaaggtatcctcccacctcaatttaccaagtagctgggactgtgggcacatgccaccatgcctgggaagactggttaactttgatgggaaatcagaaaagaccttgagtaccgaggatggactgtgaaagtgaatgatgaggtgtagaacaaaatggggagaggacactggaaattgcctcacttacctcaggctaagagttctgaaagctcccctagcaacttcagtccgtgggaagcttctgtaaaaatctttattttaaacttttattttaggttcagaagtacatgtgcaggtttattatataggtaaactcatttcacaagggtttgctgtacagattatttcatcatccaagtgttaagcctagtacccaatagttattttttctgctcctctccctcctcctaacctccgccctcaagtaggccccagtgtctgttattccttctttgtgttcatgagttctcatcatttagctctcacatataagtgacaacatgcaatatttagttttctgttactgcattcgtttgctaaggataataacctccagctccatccatgttcccgcaaaagacacaattgcattcttttctatggctgcatagtattctatggtgtgtaagtaccatattttctttatccggtctgacattgatgggcatttaggttgattccatatctttgctattgtgaatagtgctgcaatgaacattcacatacatgtgtctttaaggtaaaatgatttatattcctctgggtgtatacccagtattgggattgctgggttgaatggtagttctgtttatatctctttgaggaattgccatactgctttccacaatggttgaactaatttacacttgcaccaacagtgtgtaagtgttcccttttctccacaacctcatcagcatctgttattttttgacttcttaataattgtgggcggcaagccacccaggcgccgaggcaagagaccgaggacacgagctgttccagcataataaaatataaaagaatagttataccagatatagatcttagatatgattatatacgaatatcattaatcattagttggtagtaattactctttatcccaatattatataatcctcgctctacaatcataacctaggaaaaaccaggccatacagagataggagctgaggggacacagtgagaagtgaccagaagacaagagtgcgagccttctgttatacgcagacagggccaccagaagggctccttggtctagcggtgacgccagcgtctgggaagatgcccgttgccgagcagacggtggtctagcggtagcctcagtgtcaaggaaaaacaccagctacttagcagaccgggaaagggagtctccctttccctgggggagtttagagaagactctgctcctccacctcctgtggaaggcctgacatcagtcagccttgcccgcagttatccagaggcctaaccatctccctgtgatgctgtgcttcagtggtcacgctcctagtccgccttcatgttccatcctgtacacctggctctgccttctagatagcagtagtaaattagtgaaagtactaatagtccctgatatgcagaaataatggcgtaagctgtctttctctctgtctcctctccctctctgccttggctgccaggcagggaagggccccctgtccagtggacacgtgaccttacctatcattggagatgactcacaccctttaccttgccccttttgccttgtatccaataaataacagcgcagccagacattcagggccactaccggtctcgcgcattggtggtagtggtcccccgggcccagctgccttttcttttatctctttgtcttgtgtctttatttctacactctctcgtcgccgcacacggggagagacccaccaaccctgtgggactggtccctacaataatagccattctgactggggtgtgagatagcatctcattgtaattttgatttgcatttctctaatgatcggtgatgttgagcttttttgcatatgcttgttggccgcatatatgtcttcttttgaaaagtgtctgttcatgtcctttgcctatgttttaatggggttgtttgtttttctcttgtaaatttgtttaagttccttatggatgctggatattacacctttgtcagaggcatggtttccaaaatagtttccctcattctgtaggtcgtctgtttactctgttgataatttcttttgctgtgcagaagctcttaagtttagttagatcccatttgtcaatttttgcttttgttgcaattgcttttgacatttttgtcatgaaatctttgtccattcctatgcccaggatggtattgcctacgttgtcttccaggatttttatagttttaggttttatatttaagtctttaatccatctggacttgatttttgtatatggtgtaaggaaggggtccagcttcaatttcctgcatatggatagtaccaatagtaccatttattgaatagagaatcttttccccatttcttgtttctgtcagctttgtcaaagaccagatggttgtaggtgtgcagccctatttctgggctctctattctgttccattgggctatgtgcctgtttttgtaccagtaccatgttggtttggttactgtagccctgtagtatagtttgaaatcgggcaatgtgatgcctccagctttgtttttttttgcttaggattgccttggttactcaggctttttttgttgttgttgttccatatgaatttttaaatagtttttttctagttctgtgaagaatattgttggtaatttgataggaatagcattgaatctgtaaattgctttgggccatatggccattttaatgacattgattcctcctgtccatgaccatggaatgtttagtcgtttgtttgtgttatctctgatttctttcagcagtgttttgtaattctccttgtagagagttttcacctccctggttagctgtattcctagatatgttattctttttgtggcaattgtgaatggaatcgccttcctgatttggctctcagcttggtttttgttgctgtataggaatgctagtgatttttgtatgttgatttggtatcttgaaactttgcttaagttgtttatcagctgaagaccatggggatttctcgatatagaatcctgttgtctgccaacagggatagttttacttcttctcttcctatttggatgccccttacttctttttcttgcctgattgctctgtctaggacttccaatactgtattgaataggagtggtgagagagtgcattcttgtcttgtgctagttttcaaggggaatgcttccagcctttgtccattcaagtatgatattggctatgggtttgtcatagatggctattattataatattttgaggtatgttccttcaatacccagcttattgagagtttttaatatgaaggaatgttgaattttatcaaaagcctttcctgcatctattgaggtaatcatgtggtttttgtctttagttctgtttatgtgatgaatcacatttattgatttgcatatgttgaaccaaccttgcatccctggtgttaacggtggtgggtgtccaggttcttggcatcttgaacaaagaaatggacaaaatgcacaaataaggcaaagaagggatgaaaaggcttattgaaaatgaaagtacactccacagtgtgggagcaggcctgagcataggggcttaaaggccctgttacagagtttttatgagtttaaatgccctctacttggggaatgccctatgtaaatgaagagcatgaagtgaagttacaaagtcatttacagcgtacgccctatggagaggatatttcctgtcatagctgaagtgtgaaccggccttaggttccctgcctccagaccctattttcctgcctcatctcccccgctgagagatatgatccccataaatctttatgggaggaagagggactaatggtcttttttctgtaactgcttcatgctggcttgaggcatagtccctacctattggggatcacagaacttgccctgctgtatctagttgaggcagggcagcttcttgatgaccaggggtggtgtcttcacctggaactggctggaagctttgttgcatgatcatctgaagcttaatggtctctaggtgagaggaaatgaatttggttaaaagatttaatgggaacttcagggggtggatacctatgctgtcagaaatgtttgttatagagatttgcaggagaaaaaacaaaacctggtctgttctagaatctatgtgtttccttaggacaaatcttagcacgagtgactccattttggtttggtttgatttactggggactagtgcatgagctcagttcaaaacaatggactccagaattttgtttaaaaaaattttcccttttttgtcaggttctaacttaggtgagcatgtgaccaaaacttagggccttagcgccactctcagttgccatcattgtgggtttccagtctcagcacatcatttataggttagtgtcctcatggttgcacatttcttttagctcttgtcattccagttgcagagagaccatacgacattctagaaatggctgcatgcaaacatttaaaacctttgagagaatacaacgcatcagggagactattattatgactattgtgagtaaaataccaagagtttggagtattctccttactcaaggttcccataaacaaaatctcctaaaatgaaatagatcaaagaatgagctagataaacagtttactcacttgactaagcaattttttcatcagtcctctaccactgaatttctatattcttcatttgatgtatttccccataggccacaagtgccagcagctgcacaggtacttttccgtttagctaattctattatttagcataactttcacgagagaatctaaagtctgttgtgtaactgtagcctttacagtagaatttgctgtagaacctatcatgagggatacatttctaatcattgcatcttttactttaaaccatggagaaagttgctaacaaatgatgcacttttagaaaagtgaaggccttctggcaatgttctctttaacccacgatgtgggttaagaggagtgaaccagtgttttgtttttgactgattatgaggcaacacatgtaccgctaaagtttcttacccacattgggactttatctatcaaagtataaggttatctatgtataagggtggctgcaaactccttcacaaataaaagtatacaccataagtgcacacaacagaccccttttctacttctattgttcatagaggcataagcaagaaaaaacattgaaagataagagtttcttgacagtagaagtcttaatctgtgaacttgggaaaagctgttcacatcaaatatgccatcttcttcttgggagaaatttccctggttagctttacctcaagggttccaatgggtgcacagttccaaaagtgtggagggacccttctcagttgtgagaccatgaacccaaagcctaaggtcctgaagttttgttgtagtgtaaatagcaaggcgagtctttctccgatgttctcagaagatccataccatgaaaagctttctttacctagtgaaaatacactgtagcataataatctactgttataacatcagcactcttgcatgggaaagcttttctacaaccagaaaacatgcattgagaataacaatggaatgaaatccctttatacaatgtttaaatgaccctccaggtgaccagatgtatctgaagctttaattgttttcccaggaatatgggatcaagtactggttataaactattttagtaatttgtaagtcactacaccaatgtattcaatttggatcattatatcttttccatgatgagtcatgaaatgcagaacttttataatgaaagctttaagaactcaggaaggacaaggtggccatccaggttctccatgagtccacgcttaattaacattagacttatatcctctcggataccagttgtttttccaaattaggtacatagcactgacaagaaaatttggttatttttgtggtttacaataacttaacataataaccgtaattataattgatagcatatacttagacattagaattttagaaatcccgtacaatttaggaatatgtattagtattattcacaaaaatatagcctaaagaagattgaacattattttgggaatcccatgtatctaaacatgtcaaataatcctgtttacctcttttctggatgttttcagggaccctctgattcatccagaaagccaggcattaggaaagacaattttgaaactgaagtttgattttggaattccagattaccataaattatttattttgccaaaatgatgactcagaaattttaaagaagcaaaaatcttttataaccttaaaaaaacccccacacattctactgttcttacacacctcacatgtaaaactatttctagtagtcttaattgcatgttataatggcgaattttaatgtaagacccggtaagttatgttctgataaggtttgactatttccagcatagctaggggcgtggctaacttcacatgtccccaggccttacctagctggaaagcaggcaagttaaacaatttccaaaagccaaagaagcagtttatggtcttaaagcatttagcaaacctaatatttgaacataatttacaccacatgtttacattttgaagacatttgtattttaccaagaatcttgaaaaccatctttattttccaaagattgctaaagtcacacatgaactaaaagacattacattttctacttttttgacaaaatatttgatttaagctattattattaaaccaattaatttaaaacttcacagaggagattaaccagtttgcacagagagaaagaggccagagactgacaggtaagaaattcttacccttttgctggcaggccaggtttctgggttctctctccctgagcggccctagtgaacctgcttgactgcatgcaaaaaaacacattgctatgaattaagaatattcatagatagtttacaaattttggagaaactaggcagagagagaaatatgactcaaattctatttgtaagcatatactcaatacacttaaagtgtcaggaagcctaaaatccataaagttagttgaaggataaaaagctggtgtgctccaataattcctgcagcccaacaagggtagtttaggaattccagataaatagaaaggatgataacttgctagaaatgcacaggaaacaaaataactattcacagaaccaaataaaaggcttacactagcatggttttatgtatatggatacacaagcaaagccagaggaaaataaatagcaaacaaatgaaaactagaagcaaaaacaaacaaaaaattaacctaaattttcctactcaatttaccatggaggctacagttttacctagggccccccctaaaaccccacataatgaatattttattcctgatacacaattcaatatccttaagttcaccaatatcattatacattctgagcaatcaggaaatctactttaggcacatgaccagtaagtactccagcaccatccacgcaaaacagtaaacatactgtgaagcaatgcaagcatgtatgtgaaatttggcttcacactaaatccagcttcatggttaactatattaaaaaaaattgccaaactgccaatgcatttttacaatacttcttactttaatcaagactaagagctttaactatgaaaatgttaattagccaaatgtttccaattctttatcaggttttaaagaatattttatttaaactttttccacatctttctctcctacttaatggttccttactacattgtttcataaataaccttttcaaatctgtaatttgaacgaacttttagataacttctgaattagacaaaaattattcttttttcactaataacataaccctttctggcacattttgtatacagaataacgtgttaactagaattttatccttagtaacctaaactttagcgaaaccctaagaagcaagaaatcctgaactgtcagaaatgggcatttatagataagaacaattccacaattttagaaacatatttccccatatcacaatcctttcttaattggaaatgacccagatattaaatgaacatcaaaaataactttaagattttaatttacacaaaaagtttacctaaaacatgtatctcattcactgtagttaatttttacttttaacaagggagacatgagacatcaagcaacatatgtaaaatgaacactggtttggtacagaaaggtgggacaactcgaggcaaggagagggcttgggggctttcagatcacaggtgggagacaaatggttgcattcttttgagtttctgatgagcctttccaaaggaaacagtcagatatgcatgtatctcagtgagactttgaatagaaggggaggcaggcttccccccaagcagctcccagcttgaattaacactgacattttaaaatatctaacaaagactaacataacattcagatgaaatgtatgctgacaattctgaaggcctttctatttttattccaccaataattttaaagctagcttttttagtaaagttatacttagatcacgtgaacttgaacttgaaaatagacttatttacttaattgatgaatgctcttttacttataagctaatttggcagacacaacatataacaataagtgtacacacaaacacatctagtcgtgtatacacacacataaacaaagatccaatagcttggaacctcagctatgaggtagcaatacaagcttgccggttttactttgccccagtagataatccaaggaaggctgtgaaccaaaattttgggtaaagcagtctccatggcagtttgattttcaaaaactaaacctccccagactccaaggagcactgggccaaacagtaccaaatgagggcgtcacacgttaaccacgccccctgcttagaacagcagcacaaaggcctggatacatgcaatgccatcccactttcccattagagagtaaacttcagattctaaacaattttggggccaagcagcactgcaactgcgaaagaaaattctatggagggcttattactagacctcagaacctctgctgagagcatcctctttggagagtttgaggtctggagtatcccccagagcatcctgctgtggggtccaatcttagagttccagacatctcttgccttaggtgggcactggtgccacttcgcatgcattccctccagagcctgctatgagctttcctttggaacctgggtgtaatcctcaacgtttagcatctttataatttggtaaggccacgctttcccatgcttcccattccatgaactttaatgataggaactggaggctgggtgggtttcctttgcctttagccagttgaataggggaagggaagaatttagcataaaaaaaagaaggtttaagtcatctgaaacgtttgggtttgctccaagctgccctgcacatagggatcagggaccacgtgtggaaaagattttttaaaaagtcattcaccctttggggcagggaaattattcccattcattccttggccttcaggcaatactgagcagtgaccccagccaatttgccctcattttcaaggagctattaggaaacagccgctgaaaaactgaaaaagaaagaggaaaaggaaaaatgaaaaagacccggatcccttaaactaaccaactggtggcagttaggcttctccacatggaaaccccttagtttcactgactatgaccagaaacctgcagttgcttccatgtttagatgctgcccatcaagggtcctgcgttggaaaggaaaagagagagaaagagattcccttgtatggagcagaaaggaaaaggagaaaggagaagaataaatcccaaacttttgtaagataccataaatctttctgagtttctcttcaaagggtttagcctgttaactttcttatcctttgttctcaaactcaactttcttgttcttccttgccccctagttaccgtaaacagcctcttcctgtcagctctaatcaacaactcacatctgttcccttggttacctgtacccattgttcccccgaaactgtacgtctcacatgttccacctctgtaccttacatccccctccccttctatatttaggaaaatatgtacaagtagccaatcgggtcagctcagactgtgcggtccaaccgcagcccatggaggagtgacacacagagagggactgcgttaaggataaaaccctcctggtctcctttgttctctgtgctcttgtgatcttgattgacgcaaatagtacccttctgcagaagtaaattgccttgctgagataattaaacttttgcccgagtgcttgttttacttcatggcgctgagcatttattcctggagcattttatatccaagaattcgggcttacctcttcctcctggctggcttaccaaatatatattaccaaatatattaacagtggagggggtccaggttcttggtgtgttggagaaagtattggataaaatgcacaaacagagcaaggaagggacgaagggacttattgaaagtgaaagtgcgctccacagcgtgggagtgggcctgagcatagtggctcaaaggccctgttacagagttttgtgagtttaaatgccctctacttggggtatgccctatgtaaatgaagaggatgaagtaaagtttcaaagtcatttggcctacgccctatggagagggtatttcctgtcattgttgaagtgtgaatcggccttatgttccctgcctccagaccctattttcctgcctcactgggataaagcctacttgattgtggtgaataagctttttgatgtgctgctggattcagtttgcctgtattttgttgaggatttttgcatcgatgttcatcaaggatattggcctgaagttttcttttattgctgtgtctctgccaggtttaggtgtcaggatgctgctggcctcatagaatgagttagggagaagctcctcctcttcaatgttttggaatagtttcagtagaaatggtaccagctgttttttgtacatctggtagaatttggctgtgaatccatctttcatttggtaggctatttattactaattcaattcagagctcattatcattgtggtataataatatatttggtgtttgtcccaggttcctggcacagagctcttttaaaaatttcctgaattataggaatgtcttttgttttcataacaagccctttaaatcgcacctgagtttatgctaatgaggtgacttaaaatggagcccctaggtagccacaggatgtggatggacaccacaaagaccaagtaattagagggttggagatttcaggcttgccaacaaacctcctggaagggagaataagaagggttgttaccagaaaaactggtcccccataatggggtctatccctgtttggtaccatgaagccaatacacaaaaccgcaagtgagcatcaaaaagcggaggctttcaaaattgacaaatgggatctaattaaactaaagagcttcggcacagcaaaagaaactatcatcagagtgaacaggcaacctacagaatgggagaaaatttttgcaatctatccgtctgacaaagggctaatatccagaatctacaaggaacttaagcaaatttaaaagaaaaaacaaccccatcaaaaagtgggcaaaggatatgaacagacacttctcaaaataagacatttatgcggccaacagacatataaaaaaagttcataatcgctgctcattagagaaatgcaaatcaaacccacaatgagataccatctcacaccagtgagaatggcgatcattaaaaaggaaacaacagatgcaggagaggatgtggagaaataggaatgcttttacactgttggtgggagtgtaaattagttcagccattgtggaagacagtgtggcagttcctcaaggatctagaaccagaaataccatttgacccagcaatcccattactgagtatatacccaaaggattataaatcaatctactataaagacacatgcacatatatgtttattgcagcactattcacgatagcaaagacctgcaaccaacccaaatgcccatcaatggcagattggataaagaatatgtggcacatatacaccatggaatactatgcagccataaaaaaggatgcattcatgtcctttgcagggacatggatgaagctggaaaccatcattctcagcaaactagcacaggaacagaaaaccaaacactacatgttctcactcataagtgggagttgaacaatgataacacatggacacagggaggggaccatcacacactggggactgttgaggggtgggggactaggggggagatagcattaggagaaatacctaatgtagatgacgggtttatgggtgcagcaaaccacccatcctgggcaacatatataaacataatttttttaaaaaaaattagctaggcaggttagcatgcacctgtagtcatagctactcaggaggctgaggtgggaggattgagcctaggagttcaaggttagactgagctataattgcaccactgcactccagcctagattgttagatatgagttctaaatttctcttcagaaaaccaatatgtcagtctgttcaattctttgccttctacttttaaacttaactttctcataaagcaaccttttttgattacctgctccaccctgactcattccgattacctgctccaccctgacttattctccaccctgactcattctgatttcctgctctgccataaccatttttcctgccaaaccactcaccccgtcactctctttaagttagccaatcggaattaatttagcctgtgcagtctcaccctagccaataggggaaccacacagcagcagtggccacgtgcgtcagggataagaaccccttcccctcccttgtccaagtgtgtgctaccattgctccatctataagggcgcacccttctataaaagtaacttgccttgctgagaattaaaaataaaattttatattcgagtgctatttcttttgtggcaccaaaactttatttataacaagatgacagaatgagaccctgtctctctaaaagtaaatgaataaataaataataaatagattgtgagaacagataaaagtaaataaatacataaaaattttaaaaatacaaaaaatgatgtaagtagttgtttattgcagtgctatctataatgtcaaaatattggtgatatcctgcatgtctattgatagaggattggttaaataagttatgatacatccatttagtgggtcactaagtattggttaaacatggtgatgtttatcagtcattgaaaggcaaagagtgtgtggggttgggaaggagtgttgtatacaaggaggttgtgggggtgggggtgggggtgtgtggcggtatacaaggaaagatttttggaaatatgtttaccaaaatgttaacagtggtcacttctgtgtggtgggattcagaagtgatttttagtttcttaatacatttctgtattgtttaaagtttctaccatatccatgaagcatttttacaataaagagacaactgtaagaaatttttattttgaaaaagtaatagagctactttgattatagtatgattggactttgattcagttatgaataataagctagcccgctcccaattataaagtacctggataaattagtgtaaaacctgtcttttctcttcaagtcccatatgttcccctttatatgtctctgactccaaagtgtttactaacctgaggttgggggtgggcattgtgtattagagcatcttacttactcatctccttgtgctgaaattggaacctttgatcctggataatattgttaccagaaaccacttgattagagctgaactgtagtgaattctctagaggtttgttcagccattggcttaagctctctagataaagtttaaaaaatttcctgagttcatacagcagtgttgcctcagtgggtggtacccaaaatgataaagtcagtgttataccccctgttcctgttattatcatgggtgctagcagattccagcaccagccacacatgaatgctttaagacaaacagtccaagcagctcacaaagttacaggaccagggcatggtttaccttcaggaggaagcaggcaggatcaattttgaggttcatcagcttattaacccagaactactggcccccattttccacaatgactcaagcatcggctcacccattggattatctctttattttcttggtgattttttctgggatctgctttctcttccaggtccctgccttggtaaggacctttgtggtttagttcaagttgacaggtttcctcagcttggaatctgaagggagaggttcgcttctcattcttttcattcatcttcaccacagaaggccctatgctctacagctttcttcccagatttgcatactagaggggcagacttagtgaagacctgaaagatcctcctgttatcaatttactcagagcaataactacttactctcctttgaacaagagaaactctcaaaacctttgccctgaatatatatgctccaagagaatttttttgtatcttctctacaatgaagaagatggcagttttaaaaaatttaagtaaataatagtttgttcaaattactctcctcagcagctactccactacaaaagagcttcctgccaatttgagtaagtgtgtggtagctccacagagacaagtaagtcttggtacattgactgaactgtttctagacctacagaagtgaggatcagatcctggaccattgtgatcccacccaggcaatagcccttataagaaaccagcagaactcattaatccattcatttaggaaatatttcttgttcacctgctatgtggtcagcactgttacaggcactggggaatactgtaactgcccaatgagttcttcttgcctgcttcccagatacagccaattcatcaagacaggggaattacaatagagaaagagtttaacacatgtagagtcagctaaacaggataccagagttttattattactcacatcagcctcccccaaacttcagaggctagggtctttcagggatagtttggcaggcaggaggctagggaatgggtgctgctgattggttgtggatggaaatataggggtgtggaaaatggtcctcctgtgctgagttcacttctgggtgaaggccacaggttgggatagtgggtctggatggagtcatctggtcatcagaaatgcaaaagccagaaaagacatctcaatcttaggttatactatagtgatgttatttgctagagtaattgaggaagttgcaaatcttgtgacctctagaataatggctggtaatcatttatgcctacatcttagcagaattcaggcccccctcatcctcttaactgggtggacctttcattagttttacaaaggtagtttagttttgggaatggctattatcatttaaaatataaactaaatatctcccaaagttagcttggcccatggccagggagtttggaggttaaaggcaatatgtagttgctttggtcagatctcttttactgttacaatttcctaactgttataatttttgcaaaggtggtttcaatcccccatgttgggtttcaccacaccttattcttaggtgtgagctacagagatgggaaaaggccaaaaactgctctaacttctttctgctgacaggaggtgctgttgggatagggttggctccagggtaagagtagtgaaactgctttacagctgtccagatgtattcacagcctggttggaggttgacagcaaactataagataatgagtcctaatataaggaatgaaagtcctagcttcagaagtccttgtagaatttatctaaagccctaagggatccaggtgaatagctctgagaaccagtcagacacagggtcaccagtcgagaaagatttgtgttagaggttgttggtagacaaattgggatgaacaggaaagagtaaatttaaatataccatgccatatctttttaagtcagtttttagttcagagaacagatcaattcagttaaacaactctgtcctatttcaggaagtggtattgcagatgggctagggctctatatgtgatgaaggcaaacagatttttaataggaggcatttctatggaaacagaagaaaagcaaaggttagtgttggtcacaatttatccagatgttggtctcaaagcatctttagctatataggaagaagacagtggcaatctgacacattttttcttgcctttattacaaggaataagctccagcttgcagggcctcaggaaaaaggtaatagcaatttcattgagtccaggtcagaaaaatggaagaaaaattggaaagcatgagtttggagacttgtagctcagagagaattcaggattcagtccaaattgcagaaaataataaaaacaacaacaaccaaaaacagacaagactagaatctaacaggtgtcctatagtgtttttttttccttttatgtttttgagacagggtatcactctgtcacccaggctggagtgcagtggcataatcttggctcactgcaaccttcgcctcccggggttcaagtaattctcctgcctgtctcccaagtagctgagatttcaggcacaagccaccacacctggctaattatttttgtatttttagtagaaacggtgtttcaccatgttagcgaggctggtcttgaactgctgacctcaagtgatccacccgcctcagcctctcaaagtgctggaattataggcatgagccaccaccgaccttatagaattttttgaaacataatttttctctctccagtccccatttttacgaaagacaaatcataattggaaaaatgtatttgcaaaataagttttagtcttattatactttgcctgactgtttgcataaagtgcagcaataataattatttgacatgaaggctcttttaataaaattggcttactggtactgctttttcataaggaatctcagattggactcttaaaatcctcgagctcagccatggatttatctgtgcctgcaaatatttgtattaattggttgaattcctctcctctcagtctcaagataacttggggctcctgggcttgtcagaaagtgacattctttacttatcacaggtcaggaaccgtgtacagggactgtatacacaaggtatgaggccaattttcccaaggggctattaccagctctataagtcaactttgattccttaaagcaatctgtttatatctgaaagcatatcattccagtcaaagccttggtaatataaccagtatctccaattttgtcctgttacaaaagaaaacagattcttattgcaattatgcaaataactatattggtaaaagttaaaaatactcatgaatactttccaaagacttatgttcaagaacacttgtcaaggccaggtgcagtggctcacacctataattccagctgactttgggaggccaaggcgagtgggtcacctgaggtcaggagtttgagaccagcctgatcaacatgctgaaaccccatctctactaaaaatacaaaaattaaccaggtgtggtggtggcctcagctacctgggaggctgtgacaggagaattgcttgaacctggaaggcagaagttgcagtgagttgagatcgtgtcattgaacgccagcctgggcaacaagagcaaagactccatctcaaaaaaacaaaaaacaagaaaacacttgtcagggtcctatagatgattataaactgccttttgaaaaggatcaaaataagatgacaattgtctgtggatggcaagtcttaggacagccacagttaaagatgcagtcaacaaggaaatctggtcatttttgtggcacataataatttaatacaacagtcataattattactcatagcatataccaagacatatcagaattataggaatcatatagttttggaactcatactagtaacatatgtatatgaatataacccaagaaaaattaaataccattttatatttgacaatggtccttgtatgattttaatataccaaataaaccaggtatgtctctctctctctctcttttttttttttttaattaagacagagtctcactctgtcacccaggctggaatgcaatgtcataatcttggctcactgcaatccctgcctcccggattcaagtgattctcacgcatcagcctcctgagtagctgagattacatgtacaccaccgcacctggctaattttttgtatttttagtaaagatggagttttgccatgttggccaagctggtctcaaactcccggccttaagtgatctgcccgcttcagcctcccaaagtcctgggattacaggcatgaactaccgtgcccagccgaatatgtctcttttgcacttaaaaaggttaatgaggcaaaaaaaaaaaaaaagacacaatttagaatatgattttggaaagtttgtcgaatatcaaaggtttaaaacaattgatatcactaaataggatcacaaatcattcatttagctgaagtgatagctcaaaaatgtttttttttctttcttttttttttctttcttgagatggaatttccctcttgttgcccaggctggagtgcaatggtgcgatcttggctcaccgcaacctccgcctctcgggtacaagcgaatctcctgcctcagcctcctgagtagttgggattagaggcatgcaccaccacacctggctgattttgtatttttagtagggatggggtttctccatgttggtcaggctggtctcgaactcctgacctcaagtgatccacctgccttggcctcccaaagtgctgggatcacaggcgtgggccaccgtgcctggcctcaaaaatttaagaaaaggcaaaaacctttagtttgatagaggggagacagcttttcaaacaagacccgataaagatggcatgagacaaactcaatctgtctcttctctctcccccctttttgttcctgtagtttactcaaagggcaacatcaagaaatcctgtcctcacaaaaaatagacaaattagcagggtgtggtggcatgtgcctgtagttccagctactcatgaggctgaagtggaaggattacctgagcccgggaggtagagtttgcagtgagccatgatggtaccactgcactccagcctggtgacagagtgagattctgtctaaaaaaatatataaataaataaaaggatggccgggaaaagcggacacctttacaggtggagatttccttaaagatgtaaggtaattggattactggctttagggtggagccttttaaggaacagggccaggaaggcatgcagtttctagggcctaataggcaggcatagctgggaggcagaacagatccccaaaaattaaggatcccatttttacaccaaatcctgaatccccaaaagagggaaacactatgggaagagacagtgcataaagttctttttgtgggcatgtgggagtgctttctcctagtctccaccatctggagggtgggaatttttgggtacatgtcatggctagccttaagaattctcttgagcagttaaaatcctttccaagctcaaaaatgactaccctagactccttatgggaaaagcaatggcgacttccccatgttgtaactcactagctaaggccttggccttttactaatggtggcctgggttctatttctggttagggaatgagccctttctggattaatacttgtgcagcttttgccatttagtgattatttttccctccagggacagcttctgatatcctgtcttgaattttcctttctctgagctacttttggggcaattcagatcttgtaaaaatgacttgccatcttatgcatctgtggttatgcataagttcagttaaggcttattgatttcacatatgaagttaccttttataaaaaaaaatttcaaaagccagaaatataggctgtttgtctcagctaaaatctagtaataaaagatttcaaagtatttttcttttgagatctctgttgttaaaaatcaacttaattaaggctgatatttgggttatatacatacagatactgttttagagcccctgctctgcctctgtaaaaactcagccaacagaattctgtctgattctctgtttcctcctatctgttccttctttctcttgtatctaatctttttgacttttagggggaccagaaattacattgcattatgagaaaattttaaccttgatttataatagctatataaaacatatacttttaaaaatggttaatagccgttgcttagagtgagtgattattactacagggctatactcctatctttgttcatttaaataagaagcgcatcctcttggacacttaggagctatggaatggcggggtgagagatgattacagagtgggctgattggcactaggttgcacagcagcctcagggaaacatcctttcaatgagatgtattgtggaacattgcactgtctcgctctctataagtatatatgtctatatatatatatgtaaatatatgagagtttattaagtattaactcacacaatcacaaggtcccacaataggccatctgcaagctgaggagcaaggagagccaatctgagtcccaaaactgaagaacttggagttcagttcaagggcaggaagcatccagcatgggagaaagacgtaggttgggaggctaggccagtctagtcctttcacacttttctgcctgctttatattgtagccatgctggtagctgattagatgatgcccacccagattgagggtgggtctgcctttcccagcccactgactcagatgttaatctcctttggcaacactctcacagacacacccaggataagtaatttgtatccttcaatccaatcaagttgacactcagtattaaccatcacaagtccaccccttgtcaacttgaacccatacacatctcctgagatcatacataatcttcaaataaagacaatagtaaggtcataattacacctgacataatacaactatccttcagacaaccagaaatgcaccaattcccaacccagatactattacataaaattaacaatacttaaatgctaatatgaagtcaataaatcttatggtacatgataaaagaaaaaggaaataaaatggagatattttcttaatacaagtgtataaatgcacaaacatatttttaagaaaagaaggaagaaatactcatgacaattacagtcctcatttctgcagctggtcacgtggttgtagctcgtattgatgactactttcttctactaccccttctgtattccttttgccttcagcaaacacctcagcaggtcatgttttttttcctggtggagtgacccaaacctttaattcctgaagtgtctgggccgtttgtactcctgcctggatattagctgttgtagtttcccattgaccttaatcacagggcatggtaatattaagagatgctactaagagatgccctaatggatctcctgtattccgtgcatactcttccttacctttattgcagagtagtagactgatttcatcttgatagtccgggtcaatcaccacagtcaacactgtaactctcttcttagcctgttgacttaaaggtaggaggagccctaagtgtccgggtggcaatcttaacttccagtttaatggaattgctgttgtgtctcttggtggcagcgttcctccctttggcactaagacctctaggccagcagaacgtaatgtcgcgggaacaggaagcacaaattttgctagtgggtcactaggggagatggtgagtggtgctactttcacttctactccttgattcctgggtctgtgaatcctggctgtgggagaaagagtaccatatattggacgctgattcagagcatacatggccttctggagaactttgccccagccctgcaaagtattgtcacctagttggcattgtaattgtgacttcaaaaggccattccaccattctatcaatccagctgctacaggatgatggggaacatggtaagaccagtgaaatccatgagcatgagcccactgctgcacttctttagccataataatgagtgccttgatcagaggcaatgctgtgtggaataccatgacggtggataaagcattgcatgagtccatggatggtagtcttggcagaagcattgcctgcaggataggcaaacccatatgcagagtaagtatcttttccagtgagaacaaccctctgtacttgccatgatggaaaaggtccaatataatcaacctgccaccaggtagttggttgatcacccagaggaatggtgccatatcgagggctcagtgttggtctctgatgctggcaaattgggcactcagcagtggctgtagccaggtcagccttggtgagtggaagtccatgttgctgaacccatgtgtaacctccatccctgctaccatggccactttgttcatgggcccattgggcgatgacagaggtggctggggaaagaagctgagtggtgtccacagaacgggtcatcctatccatattattattaaaatcctcctctgctgaggtcacccgttggtgagtactcacatgggatacacagtttttgaccactcagagatgtccatccacatacctcttccccaaatttctttgtcaccaattttccaatcatgcttcttccaagtccctgactatccagccaaaccattggctttagcccatgaattagtataaaatcacacatctggccatttctccttccatgcaaagtgcacaaccaggtgcactgctcgaagttctgctcactgggaagatttcccttcacccatgtccttcaggaatgtgatagaaaggggctgtagtgctgcagctgtccacttttgagtggtgcctgcatacggtgcagaaccatctgtgaaccaggccctagtcttctcttcttctgtcaactgatcatagggaactccctatgtggccatcagtgcaggctggggaagagaaggcagagtggcaggagtgtagacaacgggcatttgagccacctcctcaagtaacttacttgtgccttcgggacctgcttgagcccaatcatgtatataccacttccatgtgatgatggaattgctgctgtgcatgactcactttatggcttgatgggtcagaaagcacgcagttcataataggcagttcgggtcacatggtgacttgatgacccatagtcaaacgttcagtttccactaaaacccagtaacaggccaagagctgtctctcaaaaggagagtagttatctgcagaagatggcagggcctcgctccaaaatactagaggcctctgctgtgattcacctatggtggcctggcaaagtctccagacagcatccctatctgccactgacacctcaatcaccattggatctgctgggtcatgtgtcccaagtggcagagcagcttgcacagcagcctgggcctgttgcagagccttctcctgttctggaccccactcaaaattggtagccttttgggtcacttaataaatgatccggcataacacacccaaatgaggaatgtgttgcctccaaaatccaaataggctcactaagtgctgtgtcccttttttggttgtaggaggggccaaatgcagcaacttctctttcaccttagaaggaatatctcaacaggccccacaccattggactcctagaaattttattgaggtagaaggtccctgaattttagtcagatttatttcccatcctctggcatggaagtgtctcaccaacaagtccagtgagtttgctacttcttgctcactggatccaatcagcctaatgtcatcaatgtaatgggccagtgtgatatcctatgacagtgaacagtgatcaaggtctctctgaataagattatgacacaaagctagagagtttatataccactgaggtaggatagtaaagatatattgctggccttgccagctgaaggcaaattgcttctggtgggccttatggacaggaatggacaaaaaggcatttgccaagtcaattgctgcatactaggtaccaggagatgtgttaatttgctcaagcaatggaaccacatctggtacagcagctgcaattggattcaccacttggttaagcttacgataatccactgtcattctccaagatccatctgtcttctgcccaggccaaatgggagaattgaatggggatgtggtgggcatcaccacccctgcatctttcaagtccttgatggtggcactaatctccacaatccctgcagggatggaatattgtttttgatatactatttttctaggtagaggaagctttaatggcttccatttggcctttcccatcataatagccctcaccctaccagtcagggagccaatgtgggggttctgccagctgctaagtatgcctacggcagttatgcattctggtactggggaaaatgaccacaggatgagtctggggacccactggacccactgtcagttagacctgagctaaaactccattaattacctgacctccataagcccctacttttttttctttttaagatggagtctcgctctgtcacccaggctggagtgcagtggcatgatctcggctcactgcaacatccgactcctgggttcaagcgattctcctgcctcggcctcctgagtagctgggattacaggcacaagccaccatgcccggctaatttttgtatttttagtagagatggggtttcacaatgtttgtcaggctggtcttgaactgctgacctcatgatctgcctgccttggcctcccaaagtgttgggattacaggtgtaaggcactgcacccggcccataagcccctactttaactggaggaccacagtgatgttttgagtcccctggaatcaacatcagctccgagccagtgtccagtagtccctgaaatgtctgatcattttcctttccccagtgcacagttaccctggtaaaaggccagaggtctccttggggaaggatggaagaaagattaacagcataaattgtcagtaatgtagtggggtctttcctcaaggggacccagcctcccattcattcaaggggtcctgggtctgtaaactggctcaagtctggaaattgattgatgggtcatgattctctgtttttataattcaaattagtcttttgttcattaggcctagaagttttctccttgtatgaattaagtaggaatgcagtaggcttcctatcaacttcacttataggaacactgtgattaattggtcaatgccagagctctacacaagtcagactattatgattgctgctttgcctctgctgtccattacagtagctacacccacctggcctttgacggttgagtgctgccacttgacccctgccacctcggcatccaattattcccattgtatttaaattttgtagttgaatgactgcagttcccactgttattagatctgatatacagagaagagcaattacagggctcttcaaagatgcaggtggtgccctcataaatctatttcacatggcattggtcaaggatatatcttctggaccctcccagctgggatgagcaggtctaaagtgattaatctactccaccatctcaatctgcctaagcctttggatcccttcttctacattaaaccaagggagatcaggcatttccagcttgcttacagtgggctatcttttaatccatatttcagctaatcaagcaaataaacttttagaacctttttttaactccctgactctacaccattaaatgcagagtccctacttagtgtgcccaaatcaataaattcagcctgatcctactatatattccttccaccattaccctacacctttaatatccattcccatgcctgttctccagatttctgtttatataaattagaaaactcaagcagttcttttcaagtgtagtgtgtctccttatgggtcatacgctcaacctcacctctaagggtctgccagaactttagtctagctgtaggtccagaagcaaataggggtgttgggggtggctcctgaggagaatcaacattatcttgcttggcaactgcctcaggggaggccatcactgttgcctcaggcagcgcagggtttatctccccagacaaaggtggaaaggctgatggcagcatgaattggggaggggatgttgtcactattgggaatgggaagctgtttcttcgggcaaaaaaggttcatcagagtttacaaactcagtgtacccagcttcatcatggtcctcccacatgtccccattccaagtttcagggtgtaattcttttccagtcaatgccctcactctaatagtagacagctggcgaggctgtgcatgcagttttcattgcaggtcagctactcacatgataagagcttgtgtgtgtttttctacaatttcagctctttctctacaggagataagactctcaatccgggaaatcttagcagacttgagactcagtatctccttctgaagacgggagttagaatccctgagttcatcattttctttcatcactttgaccactgaacttaggagcaaccaaccagcttcattatgttccttggttctccacatgtggtcaaaggtattatgtatagagtcactaaactccttgtctctcacaagcagtgaattaggagtgtcaaatgcatttattttgcataactctctaaacagttcacaccaacaactatcagtgttctccatactactagaagtagagtccttagcattgggtctaagcatattaagcagccaactccagaaacacccaaaccaatgagagaactccatccttaacattctgtccctctagaaccactcctggtacaaaaatctgtattagtcatggttctctagagtgacagaactaataggatagatataaaggagagtttattaagtattaactcaaacaatcacaaggtcccacaataggttgtctgcaagctgaggagcaaggagagccaggctgagtcccaaaactgaagaacctggagtccaatgttcgaggtcagaaagcattcagcacaggagaaagatgtaggctgggaggctaggccagtctagtcttttcgcgtttttctgcctgctttatattgtagccgtgctgacagctgattagatggcgcccacacagattaagggtgggtctgcctttcccagcccactgactcaaatgttaatctttcgcaacatcctcacagacacacccaggatcaatactttgcatccttcaatccaatcaagttgacactcaatattaactatcacatggaacaatacagaaagacaaattatggcacaaagtacacaagattcactggagcctaagattagtctcataaattctttttcctattaaacaatagcttgcagaggtgataaacagtgacttttaccatttactcaattggtttgcacagagaaagagaccagaaacttggctggtaagaaattcttacacttttaatggcatgccaggtttctgggtgatatggagccaagtaacatcacaaaaaaaatcattcttttctgtttcatggaagcatagacaaaaacctctcagttttgcaagatgcagcccaacagtccaacaggctgcatgggggaacccaattaacatgttcccttctggccagagaaaaatcacgtgacaaaacacagacactagtcaccctgctcagcactcaatatcaaccttccaaggctcaaacttgccttcattggtccctgacatccttgattcagtcaaagtagggtaggatgacctccaaccagaagtttcaacagatggtctgtgagcaagatggaagagcagatggtccctgagttaggactgttgagtttccttcagggctcaccaaatgtgaccaaccagacacactaggagagcctgctggacttctatcagcaattcctttgaggaatcctgtccatgcttacaaatatgcacaatgaggtaaagatggacaaaaggacttccaaaccaaaattccagactagattctaaaccagaagagtattcctccaaataggccccatattctccatctaactggggagaaatctccccaaaccaagactctttctacaacctagggagagtcaaacagtccctgggatgggcctacagatagggcctctagggaggccaacagatgaggagaaggaagcaagtgttgccagatcctggaatactcaccaaaccaggttacaagatgtcttccaggaactatttctccattgcaattagatgcatgcactatgggttgacagcaccccagcagtagagatagtgccaggggaagcccttggtccaagagaactaagtagctgctcgggctggcctccggatctgttgctagtgaagagctaccaaactgtgggaaagtagccacaagggctatcccagatgagctcccaaatttgtaactgcccaatgggtccttcttgcccactgcccagatagagcaagacagggaatttgcaataaagactttaatacatgtagagaaagctaaatggaaaactcgagatttattgttactcagatcggcctctctgaaaatttggaggctagagtttttcaaggatagtttggtgggcagagtctagggaatagtgctgctgattggttggggatgcaaaacatagccatgtggaaaatggtccttgttcactgagttggcttctgggtggtagccacagaggagttgctggtctagttggggccatctggtcatcagaaatgtgaaagcctgaaaagacatctcaaaaggccaatctcaggttatactatagtgatgttatttacaggaataattggggaagtttcaagtcttgtgacttccagaaaaatggctggtaatcgtttatcttagcagagtttaggcccctctcatcctcctagcctggtggccctttcattagttttacaaaggcagtttagttttgggaatggctattatcagttaaactatacttttatcctaaaattagctttgcccatgtccaggaatgaccaagggcagtttggaggttaaagtctagatggaattagttaaatcagatctctttcactgtcttaattttctaactgttataaattttgcaaacgaggtttcaatattgcaatgaacaaaacagacaaaaatctttgcctgatggagcttgcagtcgactatgtttgatgggtgtttctatttattaatttactcatttgaacattcatttaataaatgtatattgagcatagactagatatcagacactatattggatcaggagttaagtccagtagaatcagagttaacagttttagggattttttatttttgaaaattgagaaaaagtaatccctttagcaattttaaaatgtacaattcagtgttttttagtagattcaccatgcggtgcaaccatcactatgatctaatttcagagtattttcattaccctagaaagaaacctcatgccaattaaccagtcatatctcattgcccctcccctaaagcccttggcaaataataatctagtttctatctatagatttgccttttctgggcctttatataaatggaatcatatagtatatggcctttttttgtctggtttctttcacttaacataatgttttcaaggtacatccatgttgtgatgtatatcagtacttcattcctttatatggttgaataaatatttcattgtatggatataccatattgtgcttatcccttcatcagttgatgaacatttggattgtttccactttttggctattaagaataatgttgctatgaaggtttgttacaagtttttgtgtgaatggatgttttcatttctcacgggtatatacctaggagggtaattgctggttcgtatagtatctgtttaacttactcaggaaccaccaaacctatttctgtggcagttgtgccattttatattacgaccagaaatgtattaaaattcccatttatccacatccttaccaacacttattttcctttttttaaaaaatggcaattctagtgggtgtgttgtgatagcttgttgtggttttgatttgcatgtacatgactagtatctgttcatgtgctagttggccatttgtatatcttctcagaataaatgtcgattcaagttctttgttcattttttaaagcattctatcaactgaggctaatttatctttttcctaaaattcatttttattttttaaaattaaattttaaaaattatttatttgtttactcatttatttattttgagacggtctcactctatcatccagcctagagtgcagtggcgtgatcataattcgctgcagcctccaactcctgggctcaagcgatcctccaacctcagcctcatgagtagctgggactacaggctcacatcgccacgtatggctaattttttaaagtttttgtagaggcagggtcttgttgtattgcccaggctggtctggaactcctggtctcaagtgatccttccatctcagcctcccaaaatgctgggattacaggagtgagccactgcacctggctaatttgtccaattttaattgagttgtttttctttttgttcttgaggtttaagcatttttttggtttattctggatactacactattatcagatacataatttaaaaatatatttcggccgggtgcggtggctcacacctgtaatcccagcactttgggaggccgaggcgggtggatcacctgaggtcaggagttggagaccagcctgacaaacatggagaaaccccgtctctactaaaaatagaaaattagccgggcacagtggcacgtgcctgtaatcccagctactcgggaggctgaggcaggagactcgcttgaacccaggaggtggaggttgtggtgagtcgagattgtgccattgcactccagcctgggcaacaagagtgaaacaaacaaacaacaaaaacaaaaacaaaaatatatattttttccatttaatattaacaggttctccttttactttttagatggtgtcccttgaagcacagaagttttttattgtgatgaagtccaaattatctattttttcttttgttgcttgtgcttttggtgtcacatctaagaaaccattgccaatgaacattaacatatacccttatgctttcttctaaaagttttaagattttgaggcggggcacaatgactcatgcctgtaatcccagcactttgggaggctgaggcaggaggatcgtttgagcctgggagtttgaggctgcagtgagctatgataataccactgcattccagcctgggctacatagcaagaatatcttttggtcattgatgtactttgagttaatttttgtatatattctgaagtaggggtccaactttattcttttgcatatgaatatccacttgtcccagcaccatttgatgaagagacaattgtctccctattgaatgatttggcatcctcgttgaaaattaattggctatagatgtatgggcttatttctatatgcttaattctattccactgctctgtatgtatatctttatgccagtaccacactgtttttaattattgtagctttgtattatgacttaaaataggaaagtgtgagtcttctttgttttaattttcaagattgttttgtttttttcagggtcccatgcaattccatatgaactcaataactgactttttcttttgcttttttttttctttctttttttgggtgggggggtggggacggggtctcactctgttgcccaggctggagtacagtggcacgatcatggctcgttgcagcttcaacctccctggctcaagccatcctcccacctcagcctcctgagtaggtgggaccacagatgcacaccaccacacccagctaattttttatttttagtagagatgaggtctcactatgttgcccaggctgggctcaaattcctgggctcaagtgatcctcctgccttggcctcccaaaatgccatgacttttctttatctgctaaaaaggccattggaattttgataggaattgccttgaatctgtagatcactttgagtggtattgccatctcaaacaatattatgtcttccaatccatgcacacaggaagtctttcaatttgtttagggcttcttggatttctttcagacatgttttgtagttttcagtttacaagtctttgacttccttggtaaaatttactcctaggcattttattcttttggatgctattgtacacagaaatattttcttaatttcctttcaggattgttcattgctagtgtatagaaatacaattgatatttgtatattgatcttgtatcttgtgaatttgctgcattcatttgttagctcaagtacattttttctggaatctttggaattttttgtatatgggattatgtcatctgtgaatagagataattttatatcttcctttctactttggatgctgttttttcttcctgtcccattgacctgactagaacttacagtacaatgttgaatgaccgtggaaagagagagagccttgtcttattcctgaacttaggtgggaagctttcagtctttcactattgagggtgatgtcagttgtgtgtttttcataaatatcctttatcaggttgagaaaatttgcttctaaatttctgagagtttttatcctgaaagggtgtcaaatgctttttctgtgtcaattgagatgatcatgtggattttttccttcattcgattaatgttgtggtttaccacattgattaattttcttatgtgaatcactcttgctgttgtaggtaaagccttcttggtcatggtttataatccttttaacatgctggagaatctggtttgttagtacttccttgaggatttttacatctgtattcataaaggatattggtctgtaattgttttttcttgtgatgtctttggctgtggtttcagggtaatgctgtcttcgtaggatgagctaagaagtattccttttgcttctagtttttggaagaaattaagaaggatcaatgttaattctttaaatgtttggtagccttcttggacttgtttttgttagaaggtgttggaaggtgtttgattactgattctctttacttattataaatgtgttcatattttttatttattcttaggtcagttttggtaatttgtgtcttattcatttaaaaatatgttttcaacatatggatgaagtacccttttcatctctgatcctgttttggtaatttgtatgttctctttttctctctttttttctcaaataatctcaccaaaagtttgccagttttattaactactcttaaaaaaaacttttggctgggcacggtggctcactcttgtaatcctagcactttgggaggccgaggtgggtggatcgcctgaggtcaggggttcgagaccagcctgaccaacacagtgaaaccctgtctctactaaaaatacaaaaattagccgggcgtggtggtgggcgcctataatcccagctacttgggaggctgaggcaggagaatagcttgaacccaggaggttgcagtgagccgagattgcgccattgccctccaacctgggcaacaagagcaaaactccgtctcaaaaaaaaaaaaagtttgtctttgttgattttctctgttttctgtatggttactatgccatttatttctatttgtttttgcttttattttcctccaccctttggtttttgtttttctgtttatagcttcttgaggtggatgcttaatccactaattttcagcctttcttctttctctctttctatatatttggccaggcaatataaatttgtcttttttgttatacatgtctatttattaatgaaaaaggaacgatcaccaacattcatttaaaaataggcaaaagacattaacaaacatttttccaaagaagatatacaggtggcaaatagacacaaaaaaatggtcaataccataagataccagaaaaatgcaataaaatcacagaaggatgctattatacagctattaaaacaactaaagttaaaaagactaaccacaccaagtattggcaagaatgtagagaaacaggaaggctcacatactgttgatgggaatgcaaatggtacagttaggttatagtttggtagtttctttaaaagtgaagcattcacatacactgtactattggaacaggagaaataaaacatttatgcatcttaagaattatatgcctatgttcatagtagcattatttataacagccccaaactggaaaacatccaattatttatctgaattgtggcatatccacagaataaatatttctcagcaatacaaatgaactattcacataaacaacattgctaaatcttaaaataattatgcagtatgaaaaacattaggaaaagaggagtaaatattttatgattccattcacataaaattctagaaaacacaaactattctcttgtactgaaagtaaatcactggactcttaaaggccttggaaagtgcaggcagactgtaaaacagcatgagttgaatcatgaatatgttcatgatcatgactacggtggtgtgttagcccgttttcacactgcagataaagacatacctgagactgggcaatttaccagagaaagacgtttaattggacttacagttccacatagctggggaagtctcacaatcctggcagaagtcaaggaggagcaagtcacatcttatgtggatggaggcaggaaaaaaagagagcttgtgcagggaaactcctctttatagaaccatcagatcttgtgaaacttattcactatcatgagaacagcacgggaaagacttgcccccatgattcaattacctcccaccgggtccctcccacaacacatgggaattcaagatgagatttgggtggggacacagacaaaccatatcaagtggtttcatggacttatatgacaaactcttcaaattatacaccataaatacatatatactatggcatgtcacttatacatcaaggaagtttgtaaaacatgtttcaaaataaaatacctgatctcccacttttcttttttctttctttctttcttttttttttttttttgagatggagtgtcactctgttgcccaggctggagtgcagtggtgctatcttggctcactgcagcccccgcctcccgggttcaagtgattctcctgcctcagcctcccaagtacctgggattacaggcgcccaccactatgcctggctattttttttttaatctttagtagagattgggtttcaccacgttgggcaggctggtcttgtactcctgacctcaggtgatctgctcccgttggcctcccaaagtgctaagattataggcgtgagccactgcgcctggcctgatctcccacttttcagaaaccagaaggcttggcatcctcatgttgactgaactgtcttttccttcaggctggaggaagggcaaccctgcatccatcagttcaggaaatatcggcaagcactgtagggtgctgtggtctgagacaatagcaacactggtggaaatcacaagtcctacatccctgtcaagtaaggcttctattatctggagtgcagtggtgcaatctcaactcattgcaacctctgccccccgggttcaagcgattcttgtgtctcagcctcctgagtaactgggattactgatgtgcaccaccacgcctggttaatttttgtagtagagatggggttttaccatgttggccaggctggtcttgaactcctggcctcaagtgatctgcctgccttggcctcccaaagtgctggggttacaggtgtgagccactgggcccagccagacttctattatctttatccttttcctgcttctacagcaacagacttgacgtaaacaacccagaaagtcaacaagaataaaaaaaactaattatttttgctgacaatgacctcagctattggtgatacacagatttctaggtcctgtcacttgctcaaagccacagtcacaggaagatttgtaaatgcacttttataaggggcacattccaagtagcttgctgcagtctccgccatatccagtatttctggaccaattatagttcacacctgactcccattgtcttctgagtgacatcagcctatggaatgtttgatatcagggcatgtctccttatagaatcttgtgaaaaacttctcaacagtcctgggcatcatatgacgtcctctaggaacaatggaacaaatttgtcctattccccgaagcacaggtgcttgtcataatagctggcttttcctcaggataacctctagtctcacagaaagtataggctccaggccacaaattagaataaccaaaaccttgcattgtttcctaggagatcttaggtagcaaaacaaatatgaccaaaatcagagtgagaattactctgtcattttactttttctgtagaggcccacaaaagctgtccactccttcatatagagttcaagtctgtttgccacccaccccacatagtaaacaaaaccccaagattacaggtagattcaaatataaggcctttagtggtggtgcatgcctgtagtcccagctactcaggaggctgaggtgtgataattgtttgaacctgggaggtggaggttgcagtgagctgaaatctcaccactgcactccagcctgggtgacagagggagaccctgtctaaaaaaaaggtatatatatatatatatatatatatatatagagagagagagagagagagagagagcgcctttgttagtgcacaaactggaacaatgtgaggcagccagttgccaggtggtgacttggaggctggaagaatgaccaagagtcgtgtgagaccaagaatttccatgaagggaagccttcttccaccagaacccaggctgggacctcctgaccaaaactgggtcagatgtgtgctgtgatcagtcagaaaagagaatgaatttccccaataggctcagactgctcaagatttcctccaaagaagaaaagaacacacagatgtctgccttgcctcagaatatcagggtgaccaatgcctactgtgcaaggtggtagaggggagacggtttctaccaaagaaacttggaagcataaggttcaacttcaggcaggtggctccctcctaaaggctctccactgccacaatactacagagacagcacattctctctaggtctaaggctcttctgaagtgtggactttcaggagctaaaagatgatagatcttgaaggtaaacactcttccacatttgctgcattcatgaggcctccacgtgttatgacatttttggtgatgaatgaggctggcgcactggctaaaggaattcccacattggttgcactcataaggcctttctccagtgagaaccacctggtgttgaataaggccagacttttgactaaagaactttccatgctggccacactcataaggccttgctccaatatgaattctcccatgttgaataaggatggaggcctttctccagtgtgaactctctggtgctaaacaagtgagtacttgccacagaaggcttccccacatttgccattttttgttttgttttgttttttgtttttgagacagactttcactctgttgtccaggctagagtgcagtgatgtgatgtcagctcactgcaacctttgcctcctgggttcaagcaattctcctacctcagcctcccaagtagctgggactacaggtgcacaccaccacacctggctaattttttttttttttgtatttttagtagagagggtttcaccatattggccaggctggtctcaaactcctgacctcaggtgatccgcccacctcggccttgaaaagtgttgggattacaggtgtaagccactgcgcccagccagctttcccacatttgatacactcataaaggctttgtccagtgtaaactcttagacagtgaacaggagtgcttgtgcctggaagccttcccacactgacctgacttgtaatgacttttttgactgtgagtgtcctctccacatttggtgatcgtgttgggcttctcagttttaggaaagaccagggacctagaagccccaagatggctgggaggtccttcccaacctcgcatttgcggaagggcttccctgacatatggaaaaggcagtgcttcacttacgaggctctgtccatgtccctcttcaaggatttctttgcactgtgatgtttctggtgctggtactggtttgcacgtgctccaaccaagtaaggttcccgcccagggagattagccagaggcaagatatctttcaggaatggaacatatatctcccggggttgagtcttcagtgtggatgaacctgccttaaactgtgacactcccacagaaacattctgctcagaaggtgtctcttcatcctctttaccatgcccacaacccagtgaggctacttttacaagaggcacattccaactagtttgctgcaggctccaccacgcccagtatttctgtacaaaatcctgggtaaaatacaagtgcaaagttctccagcatcacttcaaggtataggagcctccaagcctcatcaggcagtccctactcgtcctgtgagaagtaaatggcgatgtcctcaaaggtcatacagccctttgtgagatttatatgttcttctgtagtcatggtaacctgagccagggccctcagttctgccgctgccattggaacctgtggacggtgcgggacctggaccgggaccgggacaaggaccaagaccagcgcggtgacccgagcaaagctgtcacccccgccgccgccgacccccatacccgccactgttcagcaggagggcccctcccctcgccccttcctgccctctcgccaaacgatgcgctcccaaagctctgacggcctggatggactcaagagctgctaaaatgactgtcactggagcaataccctgtctttttttttttttttttttttttttttttgagacagagtctcgctctgtcgcccaggctggagtgcaatggcgcgatctcggctcactgcaacctccgcctcctgggttcaagcgattctcctgactcagcctcccaagtagctgggattacaggcacccaccaccacgcccagctaatttttgtatttttagtagagacggggtttcaccatgttggtcaggctggtctcaaaatcctgacctcaggtgatccacccgcctcagcctcccaaagtgatgggattacaggcgtaagccactgcgcccggcctcttttgtataggtaaataatgatcaaatattgcaactttatacggtttatcctaatatttaaggctaaaaacttgctgtaagcactggtatttcccgtaagttaaaatattgatgttacaaaattatttcttgttgatgagtgcatttatttatagtaaaagtgcaaatcaggcataggaaagatacacaccagttttaggatagtagttactttagagaaggaagggatgatgaaggaatatagatgtaacattttatttcttacaaatacagcattaaaatataaataaacatgtatagcaaataaggcaggagagtaacatctgtttaattttgttagtgggtaaatcccacaagattttatacttagatttttttatcattcagttgaaaatatttcttatttaattatgatctgtgatttcttttttttcccctcaggcctggcctgggagagcgtgtcgtcaccacatggatctatgatttctttttaaaaagtctttgagttgtttggaagtctattttaagacttctgagcacatagatattttctagttatatttatttgtgtgtgtgtgtgtgtgtgtgtgcgcgcgtgtgtttgtataaaaagagaaaaagagagagagagatgtggtaacatctcgcattacatttgggaaattttggtgaagggtatgccataattcttttttagtattcttacaacttttctataactctaaaattacgtcaaaataaaagtttataaaaaataaaaaaaagccttctctgcagactcatgtttaaaataaaatttgcttcatatgatattgattttttaaatgctatatattttgtatgatcatagctgtaaatagccatcgcactccagcctgggcaacatagtgagaccccatctttaaaaaccaaccaaacaaggccgagtgtggtggctcatgcctgtaatcccagcactgtgggaggccgaggtgggcagatcacttgaggtcaggagttcgagaccagcctggctaacatggcaaaaccccatctctactaaaaatacaaaaattagccaggcatggtggcacgtgcctgtagtcctagctacttgggaagctgaggtatgaaaatcgcttgaaaccgggaggtggagattgcaatgagccaagtttgcaccactgcactccagcctgggtgacagagcgagaccctgtctcaaaataaaataaaataaaatccaaccaaataaataaacaaccttttattttaaactttatccttttagttctttcttttacagtatatttaaggaattgatatgctaaaatactgtaatactcttatatttgatattgagtattcctcatgactatttccagttatggtgtatctgattcagttatcaaaattagcctgtgtttttcctatctggagaaatgcatcatgttattaaatattttaatttttataaatttccataaaaattattaatattgttttatatagtcaatatccatttgcccacatagtattttctttgctcttcgttaaaaaaaaaaaaatctcagttctggctgggcatagtggctcatgcctgtaatttgagcactttgcgaggctgaggtgggaggatcacttgaggccaggggttcaagactttaagaccagcctgggcaacataatgagaccccatctctagcaaaaataaaaaattggccaggtgtggcggtgcatgactgtagtcccagctacttgggaggatgaggcaggaggatcactgagcccaggaattcatggctgagccaagattacaccactgcactcccgcttgggtgacagagtgagactccgtctttaaaaaaaagtaaagaaaaaaatctcagctttgacatttagaataatttttctttctcaggtacatcatttagaattacctgtagtgtgagtctactgctagcaaactctcacgttttgcttgtctaaaaatatatttcacttcaatttttttacttagaactacttaaaaaaatacatgtaaaatttaacaatgtcatgattgttctcttattgtttcatttttttttctttgagacaggatctcactctgttgcccaggctggagtgcagtgacatgatcacaggtcactgcagcctcaacctcctgggctcaagcgatcctcctacctcagcctcccaagtagcagggacaacaggtgcacactaccatgcttggctaatttgttttaaaagtttttgtagagatgggggtctcactatccttctcaggctggatttgaactcctggactcaactgatcctactgtcctggcctcccaaagtgctgggattacaggcctgagccactgcacatggcttattgtttctttttttcaccccgaatcaacctttttgctttgtcttattgttgttttcatttgtgtaactttttcctatattttgaatatttcaaactacagagaagtggaaagaattggacaataaacacctgtatactctttatttggattcactaattgttaatgttttgccacagtttctcttttttcttctcatcttttccccctttttcttcctctgttcttcctcttcctctctgtctcctaccaaggccactgctgcctccttctctttctcctcctcttcctcctcttctttttctatttcttgttcatgctaaaccaattaaagcatattgctgctggctgggcgcaatcgctcatgcctgtaatcctggcactataggaggctgaggcagaaggatcatttgagcttaggagttcgaggtgagcatgggcaacatagtaagatccctttctcaacaaaaataaaaataagaaaattagctgggcatggtggtatgtgcctgtagtcccagctactcaggcggctgaagcaggaggatcattgcttgagcctgggaggtcaaggctacagtgagctatgatcacactgctgcactgcagtctgggcaacagagcaagaccctgtcacacacacacacacacacacacacacacacacaaagcccaaaataaaacaaaaaagagtatgttactgacattatgccacttcactcctaacattttcaggatatattgcctaagaacaaggacattctcctacataaccataacttaattattacagttcaggattttaacattagtacaatattattaccaaatactaagtccatatggaaaattttccaattgttccaataatgttctatacagtttttaaaaatccaggatccaggccaggcgtggtggcttatgcctgtaatcccagcactttgggaggccaaggccggtgtatcacttgagatcaggagttcgagaccaacctggccaacatggtgaaaccctgtctttactaaaaattagctgggcatggtggtgcatgcctataatcccagctactgcagaggctgagacaggagaatcacttgaacccaggaggtggaggttgcagtgagcagagatcacaccactgcaacctctgtctcccaatttcaagtgattttcataccttggcctcccaagtagctaggactacaggcgtgtgccaccacacccagctaatttttctgtttttagtagagatggggtttcaccatgttagccaggctggtctcgaactcctgacctcaagtgatctgcccacctcggcctcccacagtgctgggattacaggcatgagccaccacactcggccttgtttggttggtttttaaagatggggtctcactatgttgcccaggctggagtgtgatggctatttacagctgtgatcatacaaaatatagcattttgaaaatcaatatcatatgaagcaaattttattttaaacctgagtctgcagagaaggcatttttttttattttttataaacttttattttgacgtaattttagagttatagaaaagttgtaagaatactaaaaaagaattatggcatacccttcaccaaaatttcccaaatctaatgagaaatttaccacatctctctctctttttctctttttacacacacacacaaagataactagaaaatatctatgtgctcagaagttttttatttatttatttttattttttatttttatttttatttattttttaattagtatactttaagttttagggtacatgtgcacattgtgaaggttagttatatacgtatacatgtgccatgctggtgtgctgcacccactaactcgtcatctagcattaggtatatctcccaatgctatccctcccccctcctcccaccccacaacagtccccagagtgtgatgttccccttcctgtgtccatgtgatctcattgttcaattcccacctatgagtgagaatatgcggtgtttgtttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggcatcgccacactgacttccacaatggttgaactagtttacagtcccaccaacagtgtaaaagcattcctatttctccacatcctctccagcacctgttgtttcctgactttttaatgattgccattctaactggtgtgagatggtgtctcattgtggttttgatttgcatttctctgatggccagtgatggtgagcatcagaagttttaaaatagacttccaaacaagtcaaagactttttaaaaagaaagaaatcatagatccatgtggtgacatcatgctctcccaggccaggcctgaggggaaaaaaaaagaaatcacagatcataattaaataagaaatattttcaactgaatgataaaaaaatctaagtataaaatcttgtgggatttacccactaacaaaattaaacagatgttactctcctgccttatttgctgtacatgtttatttatattttaatgctgtattggtaagaaataaaatgttacatctatattccttcatcatcccttccttctctaaagtaactactatcctaaaactggtgtgtatctttcccatgcctgatttgcatttttactataaataaatgcactcatcaacaagaaataattttgtaatatcaatattttaacttatgggaaataccagtgcttacagcaagtttttagccttaaatattaggataaaccgtataaagttgccaatatttgatcattatttacctatacaaaagagaccgggtacagtggcttatgcctgtaatcccatcactttgggaggctgaggcgggtggatcacctgaggtcaggattttgagaccagcctgaccaacatggtgaaaccctgtctctactaaaaatacaaaaattagctgggcgtggtggcgggtgcctgtaatcccagctacttgggaggctgagtcaggagaattgcttgaacccaggaggcggaggttgcagtgagcagagatcacaccactgcactccagcctgggcaacagagtgagactccgtctcagaacaacaacaacaacaaaaaatccaggatccaatttaggatcataaaatacatttagttgtcagtgtttgtttaattttccttaatctagagcagttcccctgtacttttttttcttcaggctttcatgacattgtctttttcaaaagtccaagctagttattttatatttgtctgattgttttattttgattaaatccaaattaaaaatacttggcaaaatactacataggtaatgttatgtcctttgtgcatcttatcaggagacataagtttgtcccattatttacctccgttcttttttgttccttttttttttttttgagacaaggttgtctctgttgcccaggctgcagtgcagtggcgtgatcactcactgcatccttgaactcctggactcaagtgatcttctcatcccagcctcctgagtagttgggactacaggcatgccaccaccatgcccagctgatttttaaaattttttgtagagacgggatctcattatgttgcccaggctggtcttgaactcctggcctcaaaggatcctcctgcctcagcctcccaaactactgggatcacaggcatgacccagtgtgcccagcctcacctccattcttttttttgtttgttttcagaaaagcacaattttaatgctgctagcagtattgacaaatatttgagctcagatttgacaccacatggatctatggctattttaacaagacatcatagaacttatctgttcataatgttgacaatgaggcattaagaaaggatatatgttgatcaatatctttaaagagcatattttgctagtagcttcaataatatttaccatttctgaaattcctattttgtataatgacatttttacaatcaccgtttgattgattgattgattgattgattttgagatggagtctcgctctgtcactcaggctggagtgcggttgcgcaatctcggctcattgcaacctctatcttacaggctcaagcgattctcgtgcctcagcctgccaagtagctgggattacaggtgtgccaccacgcccagctaattttttgtatttttagtagagacagggtttggtcatgttgcccaggctggtcttgaactcctgagctcaggcaatctgcccaccttggctttccaaagtgctagaattacaggcgtgagtcggcgcacctgacctcatttttgtgttttttagtagacacgtggtttctttctttttttttttttgagacagagtctcgctctgtcgcccaggctggagtgcagtggcgggatctcggctcactgcaagctccgcctcccgggttcacgccattctcctgcctcagcctcctgagtagctgggactacaggcgcctgccatgacgcccggctaattttttgtatttttagtagagacggggtttcaccatgttagccaggatggtctcgatctcctgacctcgtgatccgcccgcctcggtctcccaaagtgctgggattacaggcgtgagccactgcacccggccaagagggggtttcaccatgttggccaggctgatattgaactcctggcctcaagtgatccacccacctcagtctcccaaagttcttttttttctttttattttttcccccttttcccctccccccttcctgggcttcactgggttttgaacagtcttgggagttattttcttttcccacaacatttcactttctcctggcttccactgttgctgataagaagtcagtcttatcgttacttgatgttttgctgtctttttctctggttgcttttaagattttctctttgtctttctgtactttcactgttatgaatcaagaagtgggtttcttttcattcattttgctttgggtttctttaatctgtcagttggtgtctttcgtaggttctaagaaattctgtcattatgtttctgaatgttgcctttttctcatctttctttcctctttgtctctctggaactccgagtgtaatcaatcctcattatttgtggattgcatatgtgcagattcacctacttgctaaaatctatttgtaacccccaaattaatcttattttcatggtcattcatggacatgctcagagtggcaaaaaattggagtcacctgatgtacatgttcccagctgaagtcaaacaaggtgatgctctgccttcttgcttcagctctcatactgtacacacatgtcatttttgctatctgtttagtgctttggttttgttttttggatttttgtgctttttgttggtgattactctgtttaaaatgccccccaagcatctttctaggtacaagaaggctgtgaaaatccgtgtgttcacatgttctcactcataggtgggaattgaacaatgagaacacatggacacaggaaggggaacatcacacaccggggactgttgcggggtggggggagggggaagggatagcattaggagatatacctaatgctaaatgacgagttaatgggtgcagcacaccaacatggcacatgtatacatatgtaacaaacctgcacgttgtgcacatgtaccctaaaacttaaagtataataataataataataataataataataataataaaaagaaaatccgtgtgttaaataagcttcattcaaacatgagttaaagtactgttggccatgggtatgttaagtaagctgcctttaaacaaaaacacacataaaacaaagttatatattgattaattaatgaaataattgtgaacatatgctcacaagaacttaaccttttatttctcctaggaacaatggttcagtattcactaatccactattcacaatgactttatagaacgtaactcttgtcaacaacgagaagtgactgtgttagaacatcttctgtcttatttctttctcttttcttcttttcttttctttttttttttttgagacggagttttgctcttgttgcccaggctagaatttcactcttgttgaatggcacaaacttggctcactgcaacctctgcctcccgggttcaagtgattctcctgcctcagcctcctgagtagctagaattacagacctgcgccaccatgcctggctaattttgtatttttagtagagacagggcttctccatgttggccaggctggtttcgaactcccaacctcaggtgatccacctgcctcggcctcccaaagtgctaggattacaggcgtgagccaccgtgcccagcttctctttttttattttctattgttttgtctctctgtgtagcataatagataatttattttgatttaatttccagttcattatttgcccttcagttgcaccgtatgactactgaagtattgagttttaaacttcagttatttgttttgctgtaagttttatttggtttctttttaagtcttcagtgtcactttttagggtttcctattctctgtagatttgatctagcttatgtttcatttcatttaaaatggtaagcatacctcacagttatttaatcagataatctgtattatctgaagttagcattatctgaatagtcttcactatctgaagtttttgagggtctgtttttgttgctggttgtagccactggttattgctcttggggtctagttttcttgtgcacttggtcatcttgtattgagacaggatgttgctgtcttgcccaggttggaatgcagtgacatgatcatggctcactgcagcctcaacctcctgggctcaagtgatcctcccacctcagactcttaagtagccaggactacagatgcatgccaccatgcccatacttggttatctttgaccatgtgttcctcactgaatttaaaaattatttgtaaggaataatttgagatcaagaataaaggtatctttctccaaacatatgtgtttgtttctctcaggtacttggggttaccagcaatatggcatttccttaaacctcgttcaaggctggaggttctgtgatcaacccagagaaacagacttggattttaatcccatgtgaggacggtcccagctctggttcaaccttttcctgagggtgtagggtcctagtttattgaggggggatctactatttgtgggggctccaggctttgacttctgtcctgatgtcacttgctctgtgaattattcaaagtgaacgttcaaaaatttacgattgtcaagaactctcagagaaaaagtttcttttcctcttattcacctcactggtaaatatttaaccttcaattgtggcctagtaattccttaccattttgtcagaatttttatgctgtttttttttttttttgatggagtcttgctctgttaacagcccaggctggagtgtggtggcataatcttggctcactgcaacttctgcctccagggttcaagccattctcctgcctcagccacccaggtagctgagattacaggttcctgccaccatgcctggctttttttttttgtatttttagtagagatgaagtttcacctttttggccaggttggtctcgaactcctgacctcaagtgatccaaccacctcggcctcccaaagtgccgggattacaggcgtgagccactgggtccgactgaaagctagcatctaattcagccccttctgtctcttctgcttaaggtgaaggcaattcctactttttcttcctggcttatttatttgcttttattttctagagacaggatctcactctgtcatctaggctggagtgcagttgcatgaccatggctcattgcagcctcaaattccagagctcaagcaatcctcccacctcagcctcccaagtagctgagactacaggtgtgtgccaccactcctagttaatttttaaaattttttacagagatgaggggctcactttgttgcccaggctagtcttgaactcctagcttcaagcaatcctccctctttggctcccctaaattgctgggattacaagcatgagccaccatgacctcttcctggcttaattcctcatcttctgtgtgtgatcactcagatgggagaagacatatctccagaagaataagcagtaggtataaggcacaggacacttcctcagggcaataagttctgcagaaacataaagtaactctagttcaactacacacagctatttttgcaacactttatattacaaatcaaaactcggttcatcaatctaaaaacatcttcattcaggttgctccatagtttccatcaagaacaaagtatagggttgaagaacattcaaaaaacaaaacaaaacaaaaacaaagggcaggtactttctttgcatgtatggaactgaagagttcatttatgggttatctccaaccctctcccctaaaaggagcagctggaactaaagatgaattcacatttctacttcccgatcttggtgcttgtactttttaaataacagctttctcaacttttatccatcaatattttccccaaaattctcagacctcataattcatcctagacatcttgttaactttccatcaaaacagcagattccaactgcctctttcctccatctttccccttccccaccttggatagtttagatggaacaagagttaatggcctacagtgctgcctttcataaaagctgcttgctactaagtaggtcttgccaacatatttgcttataaaaacaggcacctctgtggcaatattttattcctatgatgctttttccattctatcaggacatgccagaaatgtgaccattttggttgatggtctttagtacagtggactcaactgttcagcttcagcatactttgatctgggttttgacttgctaagaaccttaaactgagatattttaacacatcagtgagacactgaatctcttatgaagaaggcagagagtagtgcttgaagaaactgtctattggttattaaatgtgaaaattagtgcttatagtccagcaagtttttaaaaattatctgacagaaatgcaagatatctcaagaaagtgtcttaaagcattaccttttagaacaatttgctttccaccaggatatgtgtatattgaatgtgaatgggaaatggagtgaaagtgtctgtgtataatataaagtgcaccagaaagaggaatggatggagggtgagagatggctgttcctcaggcagaggaaaagaaggaataatttatttaaacctggccatctgcctcctcctgtccctacaagtttgtagggacaattagttgaggatatactaggttacggtgtagtagtaactccaaatcttagtcgcttaacgcaagaaatatttatttgtctctcatatccagtgtaggtctgagggactttctagcatgactgtatctctatgtgtcaactaagctagtcagcctgatggaggctttaccatccggtaattgtaccattttaaacacatggttgttttaaacttgcttgatgtaacttgggaagaaagagtttgaggctcagctacatgctaccctctaactgggcacctttcttctcaatgcaactagactcatctctctaaaatgcaaactggttcacgccactcccttgcttacaactcccactgccattacagtaaagtccaaattctgattccatggtttgtaagattctccaatacctgtttttggattatttctctagcttcactccccgttagtcccctattgccctcttgcactctacgatcctgctatgcattctttttctggttcttgaattgcgtggtttacctgcatgcttttgcatactgtctttctccacctcattcatctggcaaactcctattcgtcctgagggcttacatgtcactagaatctctccctttgcctcctccaccatgctgggggtccctcctctgtgcctctatggccatcagtattttttgtgtcatagcactacccttgtgatatcataattaacagtttattatctccctcactgcaatgtgagctccatatgagcagggactatgtctgtcttgtccaatgcccagaacatggcttagcaaaatatttgtgaacaaaaaactaagtaaaagaatgattgaatgtcagaaattctgtattcttctggtgtcaggattctcctggtgccttggcttccagtcaatttgcctgcctttcctgagaaggaacttggcacctatcacctcctttgacgatagtgcatgcagcactattttccatcaacacttagggcaaagcaacaaattaaggggttggaggaaggggcagttgttcctagtgggctagtggtattgcctgcatacttgaggccccgccccgccccgccccgccccgccccgcctcgcctcgcctcacctctctttttttttcctcttgtcacccaggctggagtgcagtggcacaatctcagctcactgcaacctccgcttcccgggttcaagcgattctcctgcctcagcctcccaagtagctgggattataggtgcccaccaccacgccaggctcatttttgtatttttagtagagatggggtttcaccatgttggccaggctggtctcaaactcctgacctcagatgatctgcccgcctctgcctcccaaagtgctgggattacaggcgtgagccaccatgcccggcctatttttttcgtatttgcaattacaattttaaaaatatcagatctttccctctcaagtgggcagtaaattccctgagttctggtgccatgttttctaccacttttgaagatctccaagctcattggcccagtgcttaacacttggtaagcagcagccccagggaccaatggacagttcgcgggcagggagattgaatgcattgtttagctcaccttgtcagaggtggcaaaatttggctatgcattggttgctcatgattttgaggcatactggggaagataacaggactagaagtgtgctctagccgttggtttaagcggtttacccttgggtgaaggccttgccatatgctattattggattattgctgtgggaaaaaatttgcttcccagatctttgttgttcattttaacatgtgaacatgcaaattgagttttgttggaaaaccccaccagccactgctgaaagaaaaactggggctttacatctcacagaagagaccactcttgtcttgttctggaggctgaatttcttattctgcagaattaatgtcacagttctgattatacagtgcatttcagtcttctttttcttgggtttgactaaccatgggccctttacagcttggcctagagaaaccgtggattaatgtatatgttttgcctagacacacagataggcaaggtacagtaaaaactcaaagtcgtatgtattaagagttaacctaaggttcaacacaaagtttgcagaattctttggtaaattatctgtaaataaatatttagatgtgttaagaaattcaaagttttaaaaagatcctaagctgaatccttttataaattaaataattcatgcactgtgagtaagtaacccatacttgatctgatttaataatttgtattttcatactggatttttctaagatcaaggacgataatactgagaaatcacctatccatatgattttttttgtaagtttcattcacccactctccaatatatacagttgtaaatcaatgttgtagacattagtgctattcatcaagtttttcttgttctccttgagctcatggtaggatttcactttctggtctctttgggattgggttgggccatgtgagttgtgagtggtaataatatatcacttctaggccagagaatttcattaccaatgtgagaccttctggaaccttttcttcccattaggctgggtctatgagtgatcatgatgagcagagacctgtgccaactcacgatggacatgaagcataaatgagaaatttttattatttttattatttttttttttgagacgagtctcgctctgtcgcccgggctggagtgcagtggcgcgatctcggctcactgcaagctccgcctcccgggttcacgccattctcctgcctcagcctcccgagtagctgggactacaggagcctgccaccatgcctggctaatttttttgtgtttttagtagagacggggtttcactgtgttagccaggatggtctcgatctcctgacctcgtgatccgcccgtctcggcctcccaaagtgctgggattacaggcgtgagccaccgcgcccggccgaaatttttattatcttaagccactgagatttgaaggttgttaccctggcagatcctagcttatcctgaatgatacacaccggtacagcatgagccatccttttctgtctcacagcatgtgttccttgtttctatactgaagtggtttggatgttttgtccctccaaatctcgtggtgaaatatgacctccaatgttggtggtggggcctagtgggaagtttttgagtcacgggagtagatctctcatgaatagcttggtgccctccctttggtaatgagtgcattcttcctctgttagttcatgagagagttggttgtttaagggagcctggtacctctctcctttctttctctctccatgtgacacacatgctccccctttgccttctgccatcatagtaagtttcctgaagcctcaccagaagcagagcagatgttggtgccatgcttcttgtacagcctacaaaaccgtgagccaaataaactccttttctttatgaattacccagactcaggcatttctttgtggcaatgaaaaacggactgacacacatatggaagaggagtcaggggtgttaaagtctcttatgctagaaaatgcatctgtcagtctacagatttccaaggctatttgatggctctagttaataatttacttgggaaggactagtgaccctcagttctataacatctggagtcctggaaggtaatcagaaagctgataacattctcttccagaaaccttccaatcctttctctttcagatcaaaggcacactaaactacatgcagattttggaaaacaaaaattcagggactgtcagagtcatgattcccatggtgactattttgctaacagactctataccacctgctgtggccacctgaccttaggtaggctaattagaatccttccccagaattttatatactaatataggacacaaactataaagatataggctcaaatctgttgaaagccctcttccctgccccacatacaaaatctgatggtaggtcaggtgcggtggctcatgtctgtaatcccaacactttgggaggcggaggcaggccgactgcttgagcccaggaattatagaccagcctgggaaacatggtgaaaccccatctttacaaaatatacaaaaaattagcctggtgtggtggtgcatgcctgtagtcccagctactctggaggctgatgtgggaggattgcttgagcccgggaggtagaggctgcactgcagtgagccaagattgcaccattgcactccagcctgagtgacagagtgagactctgtctcaaaacaaacaaacaaacatacaaaaaaccacacacacacacacacacgcacacacacacacaaaggcaggaaaagaaagaaagaaaacgtgatggcagaggaggtgggaaagtaaatattctgagagcagcaatgagaaatggagatgtagagacagtgagtgagagtgagctagttgtattcctgtcctttcatccagtcatcactgaggccagtggcatccttgccatttatacatttttggttcttgagtccataaatgtactccccaatcccactgcttatttggcttaagatagttctggtcggacttctgccacttacaatgaaatgagtcctgattaataaagtggtataagcaactctttttcttatcgttattcttatctcagtgtttctcagctcttttatatcatgacacaaatggaaaatgatatttttacagcacctgggggtaaactggaggggatttgtgggtgtctatgtgggactcactgacaacatccattccttttttgcatcatatacagacattctccaattgagtgcccatgtgaccattctgtttttcactttcggtacggtatttaataaattatatgagatattcaacactttattataaaatagcctttgtgttagatgattttgcccaatggtaggctaatataactgttctgggcatgttaaaagtaagctggtctaagctatgatgtttggtaggttaggtgtattaaatgcatttttgacttatttttaactgatggtgggtttatggggatttaagtatctgtaagttaccccatagtaagtatctgtaattatgataattaaaataaatatattttatttatttatttatttgatatggagttttgccctcgttacctaggctggagtgcaatggcgtgatctcggctcacggcaacctctgcctcctgggttcaagcaattctcctgcctcagcctcccaagcagctgggattgcaggcgcccgccaccaggcccagctaatttttgtagttttagtagagatggggtttcaccatgtaggccaggctggtctcgaactcctgacctcaagtgatccacctgtcttggcctcccaaagtgctgcgattacaggtgtaagccacagcacccagcccaagatattttaaaagatattcaatatttgtgttaaatttataaatgaaatatttttaaaaatgtttaatgaaaaaaacctgagcttgcttctgtcagtataactttttctatcaagtatgtgcttgaaatgatttcacacagttccctatcaaggttttaattatgactatttgtttttatttcttaaaatttaatttaatttaaaatttttgtatagacagggtctccctatattgcccagactggtcttgaactcctggtctcaagtgatccttctgcctcagcctcccaaagtgctgggattacaggcatgagccaccgtgcccagcccactgatgactttttgaattttttattgtcactattgacaagaaactttgttcccacaagtaggtgataaaaacaacttaaaaaaaattttccaaaacttaacaacagttgaattttttagacaactcgtggctagagtaaaaaaataaaaaacaatttaattttttgtaaattgtatttttttttagagacaaggtcttgctctattgtcctttttctcaggctgcatttgaactcctgggctccagtgatcctcttgcctcagcctccgcaagtagctgagactacagtcacgagccaccagtcctggcaatagttgaaatatattttaaaagtctaacagttcttccttttctttcactgataagcactatgatgaaataccttgtgatgacacaaatggattccaaatccaatccattttttttttgagacagtgtctggctctgttgcccaggctgtagtgcagtggtacaatctcagctcactccacctgcaacctccacctcccaggctcaagccgtcctctcatctaagccttccaagtagctgggaatacaggtgcacacaaccacacccggctaattttttatatgttttgtacagatggggttttgccatgttgcccaggctggtcttgaattcatgagctcaagtgatccgcctgtctcggcctcccaaagtgctggggttacaggcatgagccaccgtgcccagacccaatccaaattttttaatgtcaagcacagtatttcaaaataatgatgatgctgtaattttcagaacacatgggcagtcatcatgtggctagcttggatgcctctaagacagcatatcaacagcagacagacatatgtgaagatatgaatttggggccggtacacggagctgggcctactggcattttctctcctcattccctcccctagtctcaaatagatgacgtggtggttgatcacttccttgggtatactcagcatgaaacagtgaagcagtgagggacagaagttcctttagtgctggctggctgtggagacgggagggcaaaattctagattctgttctacagagcctgccctctgcaaaaaagcccagctaagttgctagcagctggtggtgactggcatgaaggctctggctccctcaagctctgcctgactgccccaaaccctgagggaatcaataattcttgccctacttataatcccttgacagtaccccagtgtctcaaggtccttcaattgggaagctctgctttattaaatctttcactagaactacacaatgggatgggagaaagacttgccattttaggccttcacaagaggggcatcccacatgcagtcactctccctcaacctctctctctaaagtccctctggctttcccaccgtcttcctcgggaagctatagcctagtcttctcctcaagagaaagagttctagtgtgttctggtttctttgtctagaggtagagggaggcttgctgctacctaggcttgggggctctggggctgaggcctgtgggtgtcgtggcctgccattcctcctgtggttaccccaacacctctaaaagcttctgctgtgccaacgcaagcttcactcactaaaacatcacaaatggggctggactgctggactcctagcaacactgtgttgtagcaaccgtgacaacagctgaaggaaacagttcctacgtgaacagattaggcttccagatttttctccttaaggcaacagaagccagtagtgaccccctgaaatgagtatgcacccctgcgattcacagaactcttgtgagagggtgcactctagagagggaagaagcatattctaatgatagctaagcgaagggctagggataatttaattagacaaataaccgaaatttgttttactttaagctaggtaagtggtatatatatttttacacttcaaatttgttatttcctgaaatgcaattgccttcaattattattggcttctagcacaagcggccttaacataaatgtaatgacgtattaaactagtgaaacaaagtgggctgttctcgctgataatcttgcctgttgtagacttcaaatctcattccaaacctcactttcctgaggaagtgctctgctaattcctgctctggcagcttatttaatcctgggtgcccttggaaaagtgaacaaaacttccgagtttttctcatatttgttcgtctgttcaaatttgtagtaagtcactcagcttactgaagtgctcctccttctatgcctctggtttgcctgaggaacacgaagacaacagccaagtacaaaggaatgtcggaaccagggtcaggccctgggagttgccttcttttcttctccccggaattaaaaatatcatttaggtcatgaaactgctacctgggttaacagccaagtccctgtctacccgcagctgtgctggcatttcagctgaccaatctcgctattcatttcttgttaactcttacttttcctcccctatgctcccctaatcactttaagcttttcccgccatagcacttagcaccctggttatatctttttttttatttctaatatctttcacgctacactaaaagttccaggagcacagggtcactgactagcttatttttcactatgtccctaacatctagcccagggtctgccgggcatagagccagcagtcagtaaatatttgttgcacacataaacaaaactctattaggcttggggacttgagcaattattttcttttctctaagcctcagtttccctatctgtaagatgagggctctgtagatattcttcaaggtcctttatagtactgacattttatggtttactttcctcaaatgtcaatcccattctcagtggattcaaaacattcctcactgatgacttcatcttccacttcgatgatatcaaaattgcccaaagtgagatcttgcaatatatcctgtccatttctaaattattttgcatagccacctcttctgtcttctattacctcttgtttcaaagaagaaagatttctccattcataattcctgcccttcccctctgttttcctctgggatcttaccttcatccattcattcaacaattatttgttgagcacctaccatgtgccagatgctatactaggtacccagaatagaactataggcaaatcaaatcccttttattcaagagtttatactcttcctctataatatctctgcagatgctctcaaatctttatcttcagcttggatacttttccaaagcttcaaactgtaatattccgagtttcttttggtcatctccacatggatgttccatcaatccctcatatcatttgtagcatatcccaaattaaactcttctcaccaaactgtttttttcttcttatcgagagtcttactttggttaatgattctatcatggtctgagccactgatatttgagaacctagagttataactgctttccttagtttcactgtctgtacaaggctgaaatggctttccaaaagatattcacatcttaatctctggaacctgtgaatgttacattatatagcaaaaggaactttgcagatgtgattaagactcttgagatggaaagattattctggataggcctgtggacaagtgtcccttataaggacaagcatctttataagggagaggtaaggacatttgacacggaagaggagaagacaatgtgactatggaagcagagactggagtgatgtggccaaagaatgctggtagctactaaagctcaaagaggcaaggaatagattctcccctggaagctccagaactagccctgctgacatcttgattttagccccataagactcattttggacttctggcctctagagcagtaagataataaatttctatttttagagatagaaatttaaaaatctttctattgtttaaacccactaagtttatgataatttattatagcagtcataggaagttaatacatgatcctccctcaaatcagttgccaagtcctttaaatctacttccacaatgtcttccagatccattctcccctcactgtctctaccattactgccctagttcaagcactcatcacctttatctggtgttactaaagtagctttctaaaaacaaagtatggttcctagctggtataagaccctccatagttcttataccataaacttctgcttgaacacttccagagatgaggagcttcctgcctatgatgccatcaatatgattattagacaactcaagtagtttgaaaggtgtcccagtaatttctttctattaggcctagttctacccatcctgtgggcttctccctaccagatcctgaggacctactgctaacttttcaggttccagcctctatttctgtcttccctgtggagttaacttgggtaggttgaactacatttcctggaattgtcttccttgtgtgtttcctcttaatgtgggccacaagagggattcttgtgtgagatttgaaaggcggaagtgaaacaacagccattttgctatccagagtaggtgtttagtaattgacccattatcatggtttctgcactaatcgccattctcatgagtctactggatgtagtcagattagcattgggtacaatagtgaataaagactggtgcagtagagaggcctgatcacttctttggcttggatggtatgcttatctgaatgtggtctagtgaattcagatcacatttaggaacatggcagcaatagcttcatgatgactgctgggctcacttctacccagagtctcattaaccccacaaaggagtctagatgtttgtttaacggggttttcttgaagctgtttcagggcgggtgcagtagcagcaaaccacttgggcctgtgaagaacatcatagcccacaccagcatatctggatggatatgctgcccagcaatgccaattatagagaaataaaaaaaaatgagcaaaaaaaaaaagataataaaaacccatgtaacttgtggacaaggcttattgacaggtgcaaaaaataaataatcttttgccactcagaactcattgttcagtatgagttttgatacacataagaaggaatattattaaaagcaaataaaaaaatcataattccactgtcctgaggcaacaactgttaacattttgggtacaacattgtttatgttctaagtttgaatctgactctgccaatgctttttgacttgggcaagtgttaatttttccagcctcaattttcccatctgaaaacagagataataatgccaacctagcagggctgttgtgaagatctgacaagatactttatgtaaagcacgtaacccatagttgctcttaaaattttagccattattattttacaaggtgtattagtctgttctcatgctgctgataaagacatatccgagactgtgtaatttataaagaaaaagaggtttaatggactcacagttccacgtgcctggggggaggcctcacaatcatggcagaaggtgaaaggcgcatcttacatggcagcaggcaagagagaatgagaaccacgcaaaaggggtttcctcttataaaacaatcagatctcttgagacttatttactaccacaagaacagtatgggggaaaccacccccatgattcaattgtctcccaccaggtccctcccacaatatgtgggaattatgggagctacaattcaagatgagatttgggtggggacacagccaaaccatatcaccaggttattccaattccaaataacagtcctaactgttaggactgttattgatctttcttctgatctttcttgtgatgtttttcttccttaaaaaaagtgaaaatgtagatagaataagattggccacaagttgataattgttgagaacgaggattcattatactattctctctctgtctctctctctctttctgtgtgtgtgtgtgtgtgtgtgtgtgaattttctacaataaaatgtttctaaaaaaaaacacacacacaaaaaacaaagaaataaagaagacttacatgcaggttttgccccaatctctcgttataaacttgttttcttcagtttaggaccctgcaagttgggcttgcaaatataaactggggccttttactaaggatattttgagatgcaactatatggcatgagccactacttttgggttacaccatttgtggataatgagatgaatgggtcactttcccctaaaagggcacaaaaatctatgggacgtggtaggggcagtatagaggtttgtgcagagaagctaatgtggcagtgacctgacaatactgttgagtagttcttgctttttaggccctctggtactgcctagttgatcttcttctgcctcccttccatcctgcgggcttctccctaccagatcctgaggacctaccactaacttttcaggaattttgtgagctagatgatgttacactgggagcttgcagttggccgtggtgggagtatttatatgatggaaatcagcaaacattagaaatcagattttttgttgttgtgaagagctgtttgctaaacatctaccagtgcaccactagtcataccattccagtaagttccatttttcctcatatgagctagagttggattctgctacccttctcctagcttctccaagtaaaacaattagtaatgagtatactgcagagagagagagcagtttgttgctgctgttactgctgctaagtgctaaacgtggcatgcggctctttttaagtcaacgactccacagatactgataaagtgcttaatttccttttctaattgtcaaatagctttttggggaattctaagtgacacataccagcactggaggtctcagagaagacaaaagctaccacagcttcttcatgcatgcctccaactccatacattccatggtttcataacaagattttcaccttctcttcttcacttttcactgagatagaggactggataagctgcaactgacctcctgcagatgtttcagatttagtggttcattgattcccattgtcaagttttccctctggttttagaatcctgttttcttttggcattaaggaaacctgggttgtacactctgtcactaactcactacatcaacttgggcaggtctcatctcttaaagctgtgattcacaaattcactctgggctctggcattgtctaactatgcctattgttgttgctgttgttgctagggtgatgggactaccattgattccctatcccaattgtctttaatgttgtttaaaaccctttcttggtccagtgttgtggctcacacctgtaatcccagcaatttgggaagccaaggcaggaggatcacttgaggccaagagtttgagaccaacctgggcaatatagggaggcaccgtctctacaaaaaataaaaaattagccaggtgtggtggtatgcctgcagtcccaacagattgggagactgaggagggaggatcgcttgagcccaggaggtcaaggttacggtgagctatgactgcactactgcactccagtctggccaagagagggaggccctatttagaaaacaagcgaacaaacaaaacacctttttcttaaataagttttttaattagatgatttttttgagaaacattcctatttcgaagttttaataacacagagtaaaatgtgagattctgtcattccttccccattcccatttccctttttagaggttgctatggttattaatttgtgtatttctttcaggtcttttaaaatacatttacatatatacataaatacatatacttgaatatagtacgcacgcatgggtaaatgggatcttactacatatcttgacttctgacttgttttcatgggctaaatctgaggagactgagccagaagactactggagaaggtggttcatccccaattcccccacttccctgtatgtggctacctgcagtgtttttgtctgattttgcccttccctccaagccccaaactccctcaatccccaacactataagataagaacattagccctccacatctgagatttgagtggaggaagaagccaattgtgaattatgtaaggttggaatgttactacaggatgtatattgcagggatttatggtgccataatttacttaacacctccctattgagcacctgtttgtctgatttttcattattacaatcttgcaaagaacatccttgtaaatacatattatgcatgcatgtgttcataagttaaattccctgaagtgaaaaagtcaaaaggaatgaaccgtgaaaagtttgagagactctgccaactgcacactcaaagatctcattttatctaccaccagtagcatatgagtgcctatttcctcacacattgttgatattagatattctcaatcttttcaatttttgtttatctgatgcaccaagaataatttcattttaatcagcatctccaccagtaactagtaggttgaacagctatttatgacaattggtcatcttttttcatcttaagaattgcctagtacaagcttgtccaatccatggcctgcaggccacatgcagctcagaacatctttgaatgtggcccaacacaaattcataaactttcttaaaacattgtgattttttttgtgatttttttttttttttttagctcatcagctatcattagtgttaatgtattttatgtgtggcccaagacaattctttttcttccaatatggctcagggaagccaaaagattggactagtacatcagtaaaatgtcagaataaggaggttgggcacggtggctcatacctgtaatcccggcagtttggggggctgagtcaggcggatcatttgaggtcaggagttcaagactagcctgaccaacatggttaatccctgtctctacgaaaaaaaaattagctgggcatggtggtgcactcctgtaatcccagctactggggaggctgaggcatgagaaatacttgaacccaggaggtggaggttgcagtgagctgaaattgttccactgaactccagcttgggtgacagagtgagactctgtctcaaaagataaaaaaaaagtcagaataaggaacttcaaaagttaattgcttcataaaagcaataaataaactggcaaaaactgtcagaatcaactttttcagaactctggaaactaataaaaatcttacagtaaccaggggaattcttaatcaggaaaacatatttggatctcagtaagagcactttgtggcatttaaacttaaactatctcccaaacccaggcttggcagtggctttgaagacaatagccttcactcctggaacaagtacccagcattggagggagtagaacagagcttattctcaaagaattctggtgtaatgttttgacctgactggtgactcccttgaggatagactcgaaggacttgcttttattttatctaacttgaaaatctcccagagttgagatggctactctgggagtgtttgccaaaaatatttaaaggcaaatgttttaggtgctcccacatggggagggataacacttgaggcaaacaatagaaaaccgaaaagcttgggaggagaggctggaaagtgagatgctttagggaataagggctttgaaaactcctacatattcttgggaatctgaatggccatatgtatgtccagggctgtgcacatgctcaggaaagaactgagaaggccataagctgtcacctctgattcacctccaggctctgtgcaagaaggtagtataggctcaggcagagttttaaactgcctgactgagtgttgaagatgtaccccaatataaacagaacttctcagtaaagactgaaatattgtgtgtgtgtgcttttttggttccaggcatgttaagaattatttgttgaatcactggctgaccactaagtgtatggaagaaggaatccagtggccacacatgacaaagaatacagaatttacaaaattagtttataaaagtcattaaacaaacaacaacaaaccatgaggagggggatttgatttttagagttgccacattataatattcaaaatgtccacttttttttttgttttttaaaagaggcatgcaatgaaacaagaaagtgtgcctgtacgcaggaaaaaagaaattaatagaaattgttcacacggaggcccctacattagatttactcaaaaagccttttaattaactattttaaatatgcttagagatctaaggataccgtgagtgaagaaccagaagagatcaggagaatgatgtctcaccaaacggagaatatccaatgaaaattataaaaagaaatctaatagaaactctgcagttgaaaagtacaataactgaaacaaaaaaattcataagaggggttcagccacagacttgagcaggcagaacgatgaaacagcaaacttcaagatttgtccattgggataatccagtccaaggaccagaaagaaaaacaaaagtgaagaaaaatgaacagaactaaggggcttgtgggataccatcaagaataccagcataagcataatgtgaactccagaagagaataagagaaaggcaaagaaagaatgtttaaagacgtaatggccaaaactttgaaaatttgatgaaagacattactttttgcctctatagagctcaatgaactccaagaaggataaactcaaggacatccacaccaacacatatcataatcaaattgtacaaagccaaagacagaatattgaaagcagcaaagagaaacaactcattatgcacaaaagatcctcaataaagattaacagctaatctctcatctgaaacaatggaggtcagaagactgtgggatgatgtatttaaagtgtagaaagaaaataaaaccctgccaatcaattctatattcagcaaaacaacctttcaaaaagggagaaactgagacattcccagttaaacaaaaactgaaggagttcactgttgttagaacttccctacaagaaatgccaaagggcatccttcaggctgaaatgtaattaccatatatagtaactctgtaactgcatgaaaaaaaaacaacaccgttaaatataactacatgggcaaaaataaaagtcagtattaatgtgtcttttgtttataactcttcttttttcccatatgatttaaaagacaattgattaaagtataaattataatctatgttggtgagtacatattgtataaagatgtaatttgcgacaacagcttcagggtgggctggagctatataagagcaaggattttttttaagttacattttttattttattgtggtaagaacacaacatgatctacctgtttgacacatttttaaatgtacaatacattattgttgactatgggtacaatgttgtacagcagatctctagagcttattattcatcttgcttcgctgaaattttatgcctgttgattagtaactccctagttctgccttcccccagcccctggcaaccaccgtttcactctgtttttggtgccaattttaaatacagttgtattcaagacattgcattttgcacttacaatacagtgcttataaagttcaatgctgtttccttcctctgtgcacatgttccatattcaagtattgagaatatccagtaatttactatagcagctgaactttaaaactgccatagaatttgctgcaaatttgggtccttcaaagttttaactgcgtggaacaatgttatatctatacatgggttaggttaatcaacctcttcaatagagggcactgaggaagcaacactagagggaggagttctgtcaccaaggaagctcccaggcattccttcaaacgcctcctgcactctggtacagcttggtaacgacggggttgcagacttcctccagctctttctgctgatgttcaaattcttccttctctgtagtaccattcttattgagccagttgctaatttcattacacttgtcaagagtcttctgtttatcctcatcattgtccttcttatggttgtgcttgaactcagtaataaaatggttgaccatttgcttgttgaagtcttctccacctaagtggagaagctgtatatttgacctcaaagattccatcctcaatagtgaggattgacagatcagaagtgccacctcttaggtcaaagatgagcacatttctttctgcttcaacctttttgtctaagccataagcaatagcagcctaagccataagcaatagcagcaatagttggctcattgataattctttttttttttttagatggagtcttgctctgttgcccaggctggcatgcagtggtgggatcttggcttgctgcaacctttgcctcctgggttcaagtgattctggtgcctgagcctcccgagtagctgggattacaggcacacaccaccaagcctggctaatttttgtatttttagtagagacgtggtttcgctatgttggccaggctggtctcgcactcctgactttaggtgatccacccgcctcagcctcccagagggctgggattacaagggtgagccaccacacctggccttgataattctaagtacattgagactagcaatggttccaacatcctcggtagtcagatgttgagaatcattaatgtaagttggcattgtgaccacagcattggtaacagtcttctcagggtaggcttctgcaatttctttaatcattgtcagaccataaatgacacctcctctggatggaaactttttgtctcttacttgtattctacttggactttgggactatctgcatcattcaccagcaagaacgaccaatgcttcatatcagactggacaacagcatcatcatatctgcatccaatcagatgtttggcatcaaaaatcatgttgatggggttcattgcaacttggttctttgtgggatcaccaattagtcatttggtatcagtaaaggcaacagagcttgggatggtttgatttccctgatcattggcaagtatctccaatattctgtgctaaacgacatccacacaagagtaggtggtgccaagatcaataccaacttgatcccttagatcccttagacatagcaacaggtcccttagacatagttacttgcatgtaggtttggcttggcttgcaaagaatacacacgaatctcgaaggctgccactatgttcaatgagccatttcacttgttgattctgtgaatttgacaattttacatacatcataaaaattgaatcatgctttatttgttatttgtccttttgtgactggcttattttatgcagtataatgtcctcaaggtctaatcatgttgtcacatattgtagaatttcttttttaaaggctgaatagtattccagtgtatatatatactacattttctttatctatttatctgttgatggtcatttaggttgtttctacatcttggctattatgaatagtgctgcaatgaacacaggagtgctaatatctctttgagattctgatttcaattcttttagataaatacccataagcgggattgctggatcatatggtagttctatttttagttttatgaggaaccttcattctgttttccatagcatctgcatcattttgcattcccaccaacagtgtataaaggtgcttttaattactcctaatccacaccaatgcttgttgtcttttttgtttgtttgtttaggagacggtctttctctgtcacccaggctggagtgcagtggcatgatcatagctaactccagctttgaaatcctgggctcaagcaatcctcctgcctcagcctcttgagtagctagggctacaggtgggtgccaccacaccgggctattacatttttttttttttttttgtagagacagggtcttactatgttgcccgggctggtcttgaactcctggtctccagtgatcctcctgcttcagcctcccaaagtactgggattacaggcacgaagccaccacacctagtcggcaatggtttcttaagtatgaaaccaaaagcacaaggaaaaaaaggggaaaaaagataaattggacttcatcaaaatttaaaactttatgctttcatggacacatcaagaaagtgaaaagacaacccatagaatcacagaaaatatttggaaatctgataacagtctagaatcccaaatacatataaaattacaactcaacaacaaaaaacaacccaatcaaaatgaacaaagaaatagacatttttttccgtggagtatataaaagtgaacaataagcatatgaacagatgcttaacatcattagccaatagaagaatatgaataaaaaccataatgagatactacttctctagcatggctgtaattttttaaaaagtgaaaataaattttggaaaggatttggagaaatgagaaccctcacacattgttgacgggaatgtaaaatggtgcagctgttgttgaaaagtttattagttcctcaataaattaaacatagaatgaccatatagcaattcaactcctagatacatacttgagaaaactggtaatatatattcacacaaaaacttgtacgcaaatagcagcattattcatagcatccaaaaagtggaagcaacccaaatttcaattattcaactctaaaaatgaatgaaatacagatacatgatacaatgtggatgaaccctaaaaaattatggtaagtgaaagtagccagaaacaaaaggtcacatattgtatgattccatttacatgaaatgtgcagaataggtaaatccatagatttatggagagcgtagatttatttggaatgtagattaatggttaccaggagctgggggtgggaaggaatgggagtgactttttaatgtgtataagttacttttggggtgattaaatgttctggaattagatagtggtggtggttgcataatattgtgaatgtatatatttctattatgtggttggtgttttattaatttgtagaaactatatgtggtggatataaaattcttttttaatatgctgcaaatattttctttcagtcttttgtctatctactaaatttccttgtgttatctttttctgtacagaagttgaaaatttttacatacatgtgttaatttttacatacatacacatacatgtgtaaatttttacatacatgtgcaaatttttacatacatgtgttaatgttttttcttatggcttttgaatttgaatcttaagaagatatctcccactccaacattataaaaatattttcagtgttttcctctaatgcttctgagctcttattttttaattaaaaaaatttttgtttttgaagcagggtctcactgtgtctcccattctgggagtagagtggcatgatctcggcttgttgcaacctctgcttcccaggcccaagcaatcctcctacctcagcctcccgagtagctgggaccacaattgtgcgccaccacgcctggctaatttttcatagagacggtgtttcactagttgcccaggctggtctcgaactcctgagctcaagtgatctgactgcgctggcctcccaaagtggtgggattacaggcatgagccactgtgcctggtctgagcttttatttttaaatgaaggttttaaaagcatctataattttttgtgctttgggcatgaagtgagagtttaactatttttttccaagtagtgctgtacaatttattgaacaattcatgctttccctaccaatttgaactattaccagtatcatattttgataataacattgaaaacgtagcagtctttggcagtcaggtctttcagagattcctgtgtaatgattgatggttattatagcctattctattttaattataaatgtactaaaataatgcaacttatctctaagcagttattttaagtatttttctctggaaggcatttttgtgaaattattcggttgtctcatcaattttgatggtggatatattcatctgctcaggctgccataacaaactaccatagagcgggaggcttgcccaacagaaatttattttctcacagttgtggagactggaaaaccaccgtcaagttccagcagggtgggtgtctgatgagtgttctccccttgggttgcagacagctgccttccctctgtgtgctcacgtggcctccttggtgtgcttgtgtggaaagaggaaggaagagggggagggtaaaggagggagaagaggaggggagaacgagcactctctggtgtctcttcttatgaggacactaatcctatcagattggatcaactctaagataatactttaatatattacttagtaatttttataactttctaagtattttcttttaagtaccttcttacttaatacttagaaaaattcctggctgggcatggtggctcacgcctataatcccagtactttgggaggctgagattggcgggggatcacctttggtcaggagttggagaccagcctggccaacatggtaaaaccctgtctctactaaaaatacaaaaattagccaggcatggtggtgggcacctgtaatcccagctacttgggaagctgaggcaggagaatcgcttaaacccgggaggcggaggttggaataagccaagatcgagacactgcgctctagcctgggcaacagagcaaggctccatctcaaaaaaaaaaaaaaaaaaagaaaaaggaaaaaaaagagaaaaattccttccttccttcctccttccctccctccctccctccctccctccctccctcccttccttccttccttccttccttccttccttccttcctgttctgtatccattctaccttcttttggcagaagcatgcccatttcctttgggaagattctttttttgaccctggataaattctggtaggaatattgatcaagataccctgccctctcctagtgtaggagtagtgatgtggacccaagctaggtcaattagaagcttcctcttgaatttgatctatgaatggagtaataaaaagaccgcataaagtgttaagcagttcttgctctacatcttctggagctccctggtttctgctttggtttctgaggagttggtttttccagtctcttcttaaacctgttcgctgccctgtagccttcaaataaattccctcttttcctaagttagccagagttgggttttgtcacaaccaaaaaactccaactcatataagggtggttcattaaatcatttggcaaatatttattaagtacttactatttgccaagggctgtactagtcaccggggagggctttccaagtgtttaatgcgctgatctcttttgtcaataagaaagaaaactgggagttaactctctgccttcattataagtgccaagaaaaaaaagagactctaggagactcccagtgctccacaggagaataattaactatcattaaataaagtttaatagaaacaataaaaacactaacgttaacattatgatgattttgtctagttgaattaattcagagctttaataatttccaactttgtaacaagtttctttagaggtcatagttattgttatactcctgagtaaatttgggtaaatccttgttgctcaccactcaggcacacattacatagtgttgcctatgtgagaagcagctctatcaaaaaccaatgccaattatttgaggcatttgcatttgggacttattaatagccatgggtgaaaaagatattcacttggtacttacggcctttaaaagatgaagcagtagtttgaaggaaccagtggtttgggagaattaaatactgattcctattgtaccccgttgacatacacagtttaagctctgatcttgtcttaaattattggaattgtggaaactgctccattaataacaattttagtaactttgggggcttagtaattggtttcaacatgacctttctcttgaaacatttagactctcctttcagattccagacatagaactagtgtagattctttggcataattgatttggagttcaaatgtaaaagcactcttttctcttacagaagcatctgaattcatatctcatgtatctcctgatcagcagccaaatgtctctttgaactgaactttggtttcaattgcctgtgaaagaacacgattcttctcatcttcctccaagcattcttcttactgcaattttatttgcccttgaaagagcctgtctttgcaattggcccttgcacgggtgtccctttaaaattgggtttccagatccataaaaattctaatttaaaatactattggttatgacttcctattcttggtaaaagaaaacaaatactcttggtgatttgaaactaagatattttcatctttgggacaaattttgtagcatttaaatttattcattgtgtggagaaaaaagttattttgaaaaattgatgaaatttttgaatattctctttaatctgtgatattttagaaaaattcaaaaagtgtaagtttcttaactcatacaaatccataaaatgatgggccacaaagctcaatgcaaggaaaaaaataatcaatgtgccctacagcatccccaaagtaaattgtgctaatatgatgtattttaagccagaccatcttgaaaataaccttcaaatttggtgaaaatatgtccacttgtttttacagctagagaacagacaaaactagagaacaggtgttaattacatacaggtaagacataagtgatctgtgcagtcattgatgaccctggccctttcttccgtgacttctgctactcattagtatctccaccagagggcagacagtaaaagagaaaggaaaggagaggaaaggacatgaggctcttgcaacccagcaaagaacttgaaactctttaagcccatctctgaattcattctgaggtcctgatggatctagtttatttgaatgacagtattagctctgatagggaactgggtcccaatcatgactcagccacttcaggtagtcaagaactatttactgagtgtctggtatatgtgaggcactgttctggacacgggatacagtacagacaaaaatgttagtttgtggaactcgcagtctagtgttgtattataatccccatgagcctcagtttctttatctgtaccatggggacaataacactggagtttctgtgagcatttaaatgagatacttaagcacctaacaaagtttattatattttaatttataccttgtacagttttatatagcgcctatacaatttttaaattttatactttacagtccatacacagttttatattatttattataatttatagtctgtacatagtctatgtagtgtctataaagttttgaattctatttgacatcattccataaacacttttctatgagtgattctacttagtattttaatggttatacaacatttcatcgtgttgatttgtcataacacttcaacactgctctattctattagatacttggtcatagaaagttctcagtaattatttgttgaaaaaaatgcatgaacatcacatacttatattacttgcatcttttcaacattataaataacactttattttctgaataatgtttctggtaactactctaaaagtaggattattgtatcaaaatgcatgacacaaggcatgaatagtttcatgatcctcaatatatattaccatcatgctgctgtaaagactggtactaatttaaaactaataactacattggggtttaatttgtattatttaattattaatattgttgaatttcttttgtatagttacttactatttgaatatccatgtagtcaaacttatctgtttgtggaccaggacaatctcgagagaagacagggcaggccttctatgtaagatgttagctacaagagcacaaataaccacctgagccataagggcatcaggagcagaaaatgaggtgacagaaggaagagccatgcagaaaataaaagggaagggcataagagacagatgttacagttttgccaaacttacagatgatagataaagactattaccacaaaggagaacctttttgttacatcatatcgagggtggggctgttttgtgcaatgagcacctgcaatgttgcaagtgaagttggtgaaccctggtatcttggttggagttgagagtgctgatgtagcactaggcatggaaacgttgatgaattagtatgaattggggcctggtttgcaatgtgatttgcatatctgtggtttggggttatgcatgccgtatatttacccctttgccctgaagaataaaattggttgagtagttgaaattaagcaatgagtctttgatctgaaatggtttggtaaaataagcaattgtgtggttttaaaaaatactgcatattgaaatattttcaaacctacagagaagttacaaatgcagtgcaaataacttccatatctgtttcacctagattcttgttaacattttactgcatttgctccctctttctcatatatatataaacattattacatatataaataatatataaacattattatattaatgtgtatatatatatacacattagtctttttctgaaccacttgagagtaagctgaagacatgatgttctatgatccttaaatattccagtgtgtctttcccctagcaagtccactctcctaacctaccagcatacagctctccaggtcaggaaatccacagtggtacaacactaccactcaatctgcagacccaattaaaactttgccaactgtcccaacaatgtctccttttcctttctggtccatgattccatccaggaacacttagttaccagcaattagttgtcatcagtgtccatctagtatttagttgtcgtatctcttcaggctccttcaatcggagagagttccatagatttttcctgtctttcatgtcctcaacagttttagcaactactgattttacattttgtaggatgagccacgtttccttatgactagactcaggccacattttcttggcaggaataccctagaaatgatgctgtgttcttcttggtgcattgcatcagagagcacacaatgccaacctatcctgtcactggtagtgttaactctaatcacggggtatattggtgtctgcaggtttctctagcataacaatgtcccttttttttctctttgtaattgatcagtattttgtggggagatattcccagattatgccaacatcctgtttctcatcgatcttctacccaccacccttaactgcctgaatcaaccaggcagttaattcagttatgttatggtggccaaatattgattctcattcccatcaatctttctacacttattagttggcattctactgtatggaacagaagggcttctcctctgttccagttatctattgctgtacatcaagctagacccaaatttactggcttaaaacaacaagaatttagctcatgaatctgcaatctaggcaaggtgatattttagctggggcagtcagctggggttagaggatccagttccaaggtggttcatcactcacatgactgactagttgttgctgtcttttgactgggacctcagctgaggctgccagccagaaccctcacatgaggccttgctatgtagctgcttgatttcatcccagcattggggttgagatttaacagcaagtatcccaagagagcaaggtggaagtgcatggcctttttctaatacaacctcagaagtcacacagctttcatttccattgtattctgttggttgaggcagtcataaatatccatctagggtcaatggatggggacatagctcttaccacttgatgggaagattgttaacatcacattgtaagaacagcctataggatagaatatattgtggtgggtatctttgtagatatagtctgccctatcctttatttatttattatttatgtatgtatgtatgtcaatatggactcatggagtcctattttgtataattggttgcgatccattactatcaacgtttattttgatgctcaaattttcccagatttgaccactgggagcccctttcaaggtggtctcggtgtccttttgacttgttcccattattctttgagcactttttctttagtggagggtggtatatgaaaactattatctgagctcttggtgggctcattgctgctgggctattattgcttgcaggtgctcttagcagacagggctggaaaatatatgtatgtatatattaatacatacatgtgcatatatacacatatgtacatctataactatttttatatctctctgagtatatatatttaaaacatgaatttatacccaaacctccaatttcaacccagaatgttaacattcggtctggtcttcctcctttctgtttttagtatcttctccaacagtgagaagcctgccacttatcttcaatataatcttcacttatttgctcaattaatgtaaacagtctctaaaccacatgagtctactctcccacctaccacttcaacaccccaccaccagtgatctacattctcaaacaggatcaggcacattaccaacgaacttccaggtggcattctgtatcgcttcagcatcccatgtctttggtcaccaataggcactcctccagcacatctctgcacagctcccctcctctctgaaactggtcaaaatgtggtacagggtcttcactttttgaaaatccacactagctcctttttcatctttaaaaaatgcaaattcgatcatgttgttcccctgcttaaaacccctgaatgactttctggtccttaggctaaatccaaaaactataatatggcctacaaaaccctacatcatttgacatcctgcctgcttcttcagtatcatctgaattatttctctgggttcagtcagtttcccagagtggaatcttccaatcttccgcttggcatgtgtaacctggctgtcagtattttgggaactgagtcaaggatggggactggaggtctcaatgttcagaaggcagactccaacttaatcccagttttcaacatagcttctcagtgggccctcagctgtgcttggtttaaatgttttctcccctgctgggatggagggagggatttgggggctgtttcttatcatcatgttcaatctatcatcctgttttcaactccataccaaaactcccactttcagagataactggtaccctcaaaacctgagctttttgaggtttggagtataaaccgcatccttgggttttggctttttctaatctgctaaaccactcatttagccattctctagtttccatatttgcacatgtacacgcatgcacgcgtgtgtgcttcttgcttattatagcctctccccctttttcctttgtactcactgcatttggccttttaatcccctgttctttttttgtgggatctcaggaaggagctcagataagtgcatgtgttcaatttgcccaatttaattggaagtgaagttgttttaaataacaaacacctgtttcattttaaagccaatcccatgaacaaaaactggatttcctggaatcatgaaatattataacaaaaaatgttcatccagtccattgtttcttgtctttttgctaccaagtatctcttttattatattatatctacccctcactccaaccccacaattgaaaagattcagacttccaaaccttagtttgggaaactttgctcaagtcaatgccctcgttttacagatgaaaagactgaggccaagagatagaagtgatttgttgaagtctaaccactaataaggggccaagttaggatgggcacccaagtctcctacttcctcttctgctgcttttctatctaggatgtgagatttctgactgcccccaaactgatgggagggtgagggaaaactttccttctgactgtggtttttcttagcaacatcattactggcattgaaacattacttcttctggtggctaagaggaaaatgctctccgccaccttgaaggccacaggtggccagacattctgggaatcactggagctttctcagggccacaggggaaccgtttgtttgaaatgtaataaaggttcctttacaccaaacgtggagaaaaagctgcactgggaacacaacagaatcagcgtgagaggtcttttctagccacttaaccagccaatcagcaagggggcgcctgctgggaactctttcctctcctggaagttaccagggatacacgggcttggccctgaaggggcttctgatcaaattgcagagaccagacagcttatcgaacagcttataacctctctaaaggcaggacctttcttattcttatttcttgtgggcctcagtgccccaggcctcctgctggacacatgttagttacctatagcttaattaaagcttctttggtgcattatttcctctccccaaagtggaaataatgagcgagtgctgagctgatgtgaccacgtagccccattccccaaggtaaagtgactacatacattttgtcttggaaactcactgccttctgcagagtcctttttcactggtaaaggttaagttttgttattctcctggatcttttgaaaacaatgcctataaatgaggaagctagcaataaaacccctactgtttgtataggctttgtagcttactgtgatctaatttaatctcctatcttgtctttttcctcagtgctttgtacacaaatgttattgattccctccagaggcagccatgtgtggtagaataaacagcatgagtctggagttttagcacccacctcttcaacgatctgagtgctgttaggcaagctgcttcccctccctaagcctcaatttacccgcatacagaatgaggaaagggtttggactccacagaatctgaggcctctctagtttctcattggagtgcaagtgccattgtgtggtttctgctgtgggcgtggttgttccaaaccaaagggcagggacaggatgcagtctgctgatcagggacagaggaagagagacacagcagctttgcacatttgtgggtccttattccctctccttacatttcccagactgtttaagttcatgatctcagggcagcgcctgtccgccccctaccacacacatcatactattcagagtttctttcccagggtctactttaaagccagtagattttcaggggtctcagatcttcttattgcttgccctcttgacatctgaggcctgaaaagaatttgggttgcctgcctaggcaggcttccggaggcctcagccttctgtcttccggggctgggggtaggagggtgccagagcacaggcagtcattgtttgggtattgactcaaaggagaaggagccacaatgcacaggaaaaaggatgagctcatgacagctaaatgaaaagattcttatcttggaaacagcggtttcttatgcagaacaaggggcggcaatgtgattgtgcccaaggagtacattcaacaacagggatttcaaatgaagaagttattttgcatacttacgggaggagcaatgggccagattgttcattaattaaagggggggggtgctgaaccccctacacacacacacacacacacacacacacacacacacacacactgcagaacttaaataattcattcgctttctcctctttctcctcagtcccagatgatcagctgagagacaaatgttttttcaactctagccacctctggagaaaggatgggggagaggatgggggaggacgggagaagggatgtggtggggaggggaggggtgtcacagataactagaatggcagtgatctctcaaccatttctatttggtgttcaaatgtattgtacggagctggtgattttttgtttcctttttttgcacccaggagatttacctttctagttctgtttgatttcacatgaaagaagtctgagcaaatccccactgaagacgagtagaggaaaggagagaaatgcagagggtgcaggtcagggaggccaggaatatgttctttgaccacagtccctctctttccccaactctgacacgtggtcccctgaggggaaggactagatctgtggctgtcctggaaattccggaatgtaggtcacccactaaatgggtaatgccagaagtggagagtagagttgtatgtggttgcaggtgggaggcatcaacaccgcccacatatctttcctatcagccagactgctctccttctaccccagatcatcttttgatttaggaataagaatggttatcatctatcaagtactttcacattcattacctcttttattatcccctctcacatgtgttatacatgtgtgccagatactttcacatatattagcttatttgagttgctcagggaccctgggagatagctcggtattactgctcctgtcttagaaatgaggataccgaggctcagagacactaagtaggttacccaaggtcacacggctcagaaatagcaaagctggaatttgaacccacatcggtcttgttatcaacatctgtgctctaaactgctatgcaatgctaactctcctccctttccctcattcttccctacatccactttgccctactgttacccaaaaggcaaacttcccatgtagttggcattctggcaagcaaagcaaggacggaggtctttcatgaatgtgagacactcctctcaaccatgcataccatcattatggaaggcaaattaaggaagaaaagcctcatagatctcctctctacctcaggctcacagataggattaacttcttttaagtgaggattattgaggtataattttcaaacagtaaaattctccttttaaaagtgcaaataagtttcaacaaacatatcctattatgtcaccaccaacacaatcaagacaggatatttttattaccccaataagttctcttgtgcttctttgtggtcagtctgctctctccatacacaacctttggcagcctctgatctatcttctattccagcagttttgcagtttcagaatgtcatattaatggaatcatagaatatatactcttttaggtcgacttctttcatttagcataacgcctttcttccttccttcctttcttccttctttccttcctctttctttctttcttttctctttctttctttctttctttctttctttctttctttttctttcttctctctttctgtctccttctctctttctttttctttctgtctttctgtcttttctttctttccctttttctctctttctctctctcctctctctccttcactctttctccctttctctctgtcactccttttctctctgtcacttcttttctctctttctctctctcctctctctccttcactctttctccctttctctctgtcactccttctctctctttctctctctctccttctctttttctctttctttcttcttttcttctcttctctttctttccttttctttcttcttttctgcagggtctcactcttgtcacccaggctggagtgcagtggcagaatcatagctccctgcagccttcaactcctgggctcaagcaatcctcccatctcagcctcctgagtagctaggactacaggcacatggcaccatgccctgttaattaaacttttttttttttggtggaggtagagtcttgccatgttgcccaggctggtctcaaacttctgggctcaagctatcctcctgccttaacctccagtgcttttgagattcatccatgtgttagttcattcctttgtattgccaagtaatattccattgtatggatgtgtcacaatttgtttatccattctccagctgatggacatttgggttgttcccagctttgagtgataattagtgaagctgctatagacatttacttacaggcttttgtgtgaatgtgtatcttcatttcttttgggtaaatgcctagacattgggttaccgggtcatatggtaagtgtatctctagctttataaaaaactgctaatggggttcagtacatgctacttcaaaatatggcatctttgcatttgagaaaacagcagaaatgggaaagtcactcccatcttccccctgccctttccctctgaagcaggtcagaaaacctaggaaggaaatccaaagttgtaggccctccaactttgttcttttgaacaaaatccttcctaggttttctgctcttcccctgaaataggtcataggaccttcatgtgagaggtgccttccctatacttggaggaaaggaacagccttatctctgaagacaaagggacacagaatgaaatctgaacaaacagagcttgcaaagtttcccccagtttgttaccattagatcatacccttttgtctttctatcatatttctccgtgattgtccactcttcatcaaacctactatgaaatatactcgggtttaactatttctttgggtcttcatttcttgacgaagccttccttgtcatgtacaacttatattaaataaacttgtttgcttttctcttgttaatctggcttttgttacaggggtctcagccatgaaactagaattggtagagaaagagattatttttcctcctctatactgttaaactgtttccaaagcagctgtactattatgaactcccacaagcaatgcataaaaattctagttgctcttcatccttgctaatacttggataatgtcactccttttaattttagcgattctaatagatgtgtattttatctcaatgtagtttttactttgcattctcctaatgatgaatgatgtgaagtgtcttttcatgtgcttatttgtcatctgtatctcttctttggtgaagtgtctattcaaatcttttgcccattttttaaaagctttattgaggtataatagacatataaaaactgcacacgtttaatgtatacaacttgatgagtttggacatatgcatactctcatgatactatcaccacaatcaaggtaataaacatatccatcaccaccaaaaattttcttgcatttcccccctttttttgtagtaagaatgcttaacatgagatctaccatcttgagtttttaagtgcacaatactgtcttgtaaactataagcactatgttgtacagcagatctctagaacttattcatccttgctgccgatttttaaactgggttgtttgttttcttatgattgagttttgagagttaattatatattctgaatacatgcctcttatcagatatgtgatttgcaaatattttcttctagtctgtggctctccttttcatttttctagtcttatcttttgaagagttagtaattttcatgaagttcaattttcttctattgttcatgctttttggagtcatatctaatagatctttgcctaacttgaggcaaagagaggcaaagaagcaaactcttgagaacaaagagttttctctcatgttttattctagaagctttatagtgttagatttacactcatgtctatgagccattttgagttaattttgtatatgatacaaggtaagggctgaggcttatttatttatttatttttttgcatatagatgtcaaattgtcacagtaacatttgttgaaaaaactatcctttcttcactgaattgcttttgcacctttgtcaaaaatcaagtgaccacatatatatgggtctacttatagacctctattctgttctgttgatctatatatttagccttatgccaacaccacgctgccttgtttattgtagattagtaataagtcttgaagttaaaatgtaggtcctccaactttgttcttttgaaaaattgccttggctcttttatgtcctttactttttccatagaaagtttagaatcagcttgtcattttctacaaagcagcctgctgtctttttggttgagattgtgtggaatctatagaccaattcgagaagaactgacattttgaccctattgagtctctgatccatgaaaacagaatgcctctccagtttttttaggtcctctttatttcatcaatgttttgtagtttcagcatacacatcttgcacatattttgtaaatttattcctaagtatttcatatttattatgctattataaatggtactgttattaaatttctgtttccaattgatatgcaattaattttcgtatactgactctgtatcctatgactttgccaaactcagttctagtagcttgtttgtacactctttgggattctttggttaaatgatcatggtgtctgtgaataaagacagttttatttcttccttttcaatatttatgtcttctatttccttttccttgcttaattgctctggttagaacctccagtacaatgttgaatagaagtggcaagagaagacatcttgttcctcttcttaggggaaaagctttcagtcttttaccattaagtatgatgttagctgtgggtttttcatagatgtgcttgatcaggttgaggatatttctttctattcttagtttcctgagagttttttttttttttaaatcgtaaatggatctgcattttatcaaaaatttttaatgcatctattgagatcaatccttggataaacactacttgatcatgaggtattatctgtttttctgtattgatggatttaatttgctaacatttggtggggagatattttctgtctatgttcatgaagaatatttgtctgtagttttcttatgtctttgtctggtttggtattgattgggttttggattgaagttattttttaagtagtgggtctgaattcagggctggtttgaagcaacagtgctttatgaaggccaagtttctcttaggctttcctttcttttgctttcctttactctgttaggccacactactgacctttcttcctgcaactgcagatggcgctggaccctcaaatagtccccctgctgctcagcgctctggacttttatgtctttcttctttgctccacttccaaaacaacaacacaatgcataaaacaacagagacctgcttcctgtgtgtgatagtcagctagtcagatacattgaaactcgtgctgaaagacctgcagtcatatccttgtctatgcttagagttgacctgagtgagctccgaggcgcctgcatacactgtcaccagggtctgagggatgatgaggggattacatccggcttgtgaacgggagtactttcacattgtcacctgtactttgcaaagatttgagagttctctgtagtacgctgagtatttaacaagcattctgacgctgagtaatgattacggctgtacataaaatagaaagattagcgtctcagttgcctgcttaatatgtaaatgtatccagttatgtgtgagtgcttttaatgaagtaacttgcatttctgcttcctacattgagagtgattgatggaaaaaaaaaacaaaaaaaacctctacaactccatcagaaattagtagccggcaggctcttcggaagagccctctggtgctgcctggcctggagctaaaaggcagtgggactggggtttagccctggttttacaattgatttctgcttctctgggcattaggaagtagacttccttatcccccaatctgagctcagagggttgttgatgatggattgtgaaatagctccactcacctgttcaccttggattggttctcattccaacatacagatatggatgataaaagtagaaactaccaggcactggtgctgagtgctttgctcatattactcccttccatcatcacaccaatcttggaagatatgaattaatatagctccactttacaggcggagaaactgaggcacagagaaggtaagtcccttgcctaatctcactctatcagttagtggctagactgggattcaaattcagatttccatggctgttgcccccaaactcttcttatcacgacacttcactgtctttttcactgctgaggttggtggcatctgtctgtgagaattatctcacttgcctgtaactggatgagcttgaaaagataagaagtgttctatgcatctgtgatgaagagctacaaccagacagtggctagggttgagcacctccttctgcacactgccacatacactgctttcggccttccgtgacaagggtaatgatttgaactgcatttctcctaaagtctggcttaagaagagtgttagacttctatctgctgtctctgtagcagtgagaggcttctttccctctgcagaggtcccacagtgggtagggaatgtttctccactgagtgtctctaattggaaaagatttatgtatagcacttgttatataccaggtacttctctaatcactttataaatacacacacatgtctgttaactcatatgatccccacaaccatcctgtgagaactcttattatttccatttcacagatggttaaactgaagcacagagaagttaagtaattcaccaaagtccccaagccaacaagaggcagaatggggctttgaacccagagaatgtagtaaccccagacctgtgctcgttcataaggtagccactagctacaggtgactatttaaatttcaatttaaatacattaaaatgaatgaaattaaaaattcagtttctcaatcacaccagccacatttcaagtacttgacaagcacatgtggctagtggctactgtatgggatggtgcatatatagaacactgccatcatcacagagaattcttattgtacagtgctgggctagagtctgttcttttaatttacttggtgtggccctctcagaatacaatctgagtatatctccctatgttgttgagttggtttccacttatctttctctccaattttctatccctcttcttttttaacttgagtgataagatagaatagaatttttgaccctttgaaaaccaggctgtaaactgtgacctaagcctcttctactaacctaccccttccccaccacctggacctcgggctcctactgatactttcatgttcaaagagctacaacctctactcaggattttgtgttagccttgcaggctccttctagaagtcccaagtcatggcagggaaggaaaggggaaaggatgccaagcgggtgtaaccccttgctacttctttctccagactttgccccttatcaaatcagtctgatatgttgcctggaaggaaagaaaaaaataaaggagctcccaaataagcaccacacaatagaagtcgagagcagttctcccctgctacactaacttatatcggcattacgacaaaattccccagagctgggacaagcagacatgtgattgacgatgataaccaaaagagatttttgtggggtttcagaggtgtaacaaagtggggtactccttaccagaaggtgtctatctatagggtggggttttagggaaattgacaaggttctatgctcctccacccctaaaataaatctccctctaggccttccaggaagtctgtaatgtctccttcccttcagagggagcgtatgctgtttacttgttagccaacatatcacatcagagggacacagtattgctcattctccccctagggctctgagcaagacaagggcagggtggggacattctggatgggtggggagtcattggctgaaaagttgcagatgtaccagacacacttcagttagttcttttgttggcctgtggccctgtctgcaggttcaaattcaggaaggaagccttgcaaagactctccatcaccacagtgcccttaaattgatgcttgtcagggcacgccaggatcaggatctgtctatctttctttctcttttctttcccttccctttcctttcctttcctttccttttctttctttctttctttctttctttctttctttctttctttctttctttctttctttctttctttctctttccttcgtctttctttcttgttcttctctctctctctcttctttttttttttccacagggtcttactctgtcacccaggctggagagtagtggtgcgatcacggctcactgcaccctctacctcctggctcaagtgattctcccaccttagcttcccgagtagcaggaactacaggagcacaccaccacacctggctcattttaagtttttttttgtagagacggagtctcaccatgttgcccaggctggtctcgaactcctgggttcaagcaatccctcagccttggcctcccaaagtgctgggattacaggcatgagccactactcccggcaataatgagatttcaaaaagagaaaggcaggccactgagtggttatttgtcgttaggttttggcatttgtggttgatacagcgggtgctttgctgctatattgccatattgacagggggtgtgaaagagtggtaacaaagactatttattccaccaagcacccaggccctgggggacaggtgacttggacagcccatgcttgagttagtgctgtcctttcttcttgttcctattcctggaagcaacctgttgccctcatgtgtgctgttataaaactttttctttttttctttggcatgatcttggctcactgcaacctccacctcccgggttcaagcaattctcctgcctcagcctcccaagtagctgggattacaggcatgtgccaccacgcccagctatttttttgtataattattattattattatttttgtagagactgggtttcaccatgttggtcaggctggtctcgaactcctgacctcaagtgatccacccgccttggcctcctaaagtgcttggattacaggcgtgagccactgcacccggccgttataaaactttttcaatatgcctttcagggtccatcatagtagtaataacaagtccttgtgcttgaatagctggctgcagtttgtgcagcattttaaaatccttgatcacacctctcaggaaagcagtatcatctccattttgatgatgagatggaggctgagagagacctcaaggtttctatgcaaggtagtgtttgagtggcacctgactggaatcctggatatctggttacccttctgcaacctgaagcttctagtacctcatcctctgtctcctttgttgggcctttgggagggagtagtttgttgcccagaaggagagacaccacagccatcacaatgagctctttcatggggtcgagttgtttagaggacttgatagtcctagcagcttctctggcctttttgtgcctcacttttcagagccgtgtcgttcttttctctggagtcaggaagcccctccataattttttttttccccactgaccaaggtccagaacagggagtgtggacacaggaatcaaggaatgttctgcagtgtgctgtcttctaacttcctgatatagatgtccagcatgccttgctgattgatgatgttcatggagatgaaaccatcctttcaggaccatggtgtgcctgaaacggtaggttaacaagtttgagttttatcttgtaggctgacattagctatggatgggtcagtgtgctaagggttagaaggaaaccctgggaacaagctgtgtgttctgggatgttgttgcaggaggacaagtaggaagcagggggagctctgcagggctaaacaaggtgaaggaatacatcctagatgtgatataataaatacttttttttaacagattaattgctatagctggcttctcagcttctagcaggtggttacaataagctgatcacagtccccaagtgtgttgtaattgtctgtttacttttcttttttttttttttttttttttttttgagacagagttttactctgtcgcccaggctggagtgcagtggcgcgatctcggcacactgcaacctccgcctcctgggttcaagcaattctcctgcctgagcttcctgagtagctgggaatacaggcgtgcaccaccatgtccggctaattttttgtatttttagtagagacagggtttcaccatgttggccaggctagcctcgaactcctgacctcagatgatccacccgcctcagccttccaaagtgctgggattactggtgtaagccactgtgcctggcctgtttatttatcttcttccctgtttttctgtgaatgttaggggcaaaggggcctagtcttatttcccagttccgagcacagaaagactcagagtaaatgcttgtttgaatgataggaattttagaactttgctcatggaaactggcaacaaattcccaacaaggactgccaatccttagcagagtctttcctgcttgtatattaggcacctgggtggaaccaccagggtcctgtttagtgtgctggagcaggctttgactaactagaaagtagttggttaaataaaaccctggtggctggcagaggtaatttctccctaacggcctgttagagaaagattattgtgacacttattaaaatggtaacgaagactttcttcaaggctgctgcaataagggacagagaccgaactcaactctaaatacaacaaggtccagtggggatttatagccaatccatttacagagtaaaggggtcaatggatggaaaattactaagagaagcttgattatatctggcacttgccataccaccacctccacttgcatgctccactcttaggcaggcacacctggtggaaagctgaagtggatgccagtgtttgcccggtagagctgcccattaaaatcacctgggaagcagcttgaaaaatacctatgcctgggctctttcccatacctagtaaatgcaaactaatgagggattcgacaaggcatctatatgcttaacaagctccctgctgattcttattatcagccggctttgggacccacagctttacactatggattgaccgaggggacaatagagagggaatgggaactggctattgggtggggatagagaggagcagggagaaataggggaggctggagcagatccagtgtctattttgctccctttccccacagacatgggttccacccttgggggatgcagagggaaggcagtagggctaccaggacttgtctgtctactcataaaaatggcaaagtaagtgaatactgtctagaatatctaccacctttgcttctcaggccttccccttccctccccgctgtctttgggaactctgtggcccctcagacatcttttatttatttatttttttgagatggagtttcactcttgttgcccagtctggagtgcaatggtgtgatcttggctcactgcaacctctgcctcccaggttcaagcaattctcctgcctcagcctcctgagtagctgggattacaggcatgtgccacaatgcccggctaattttgtatttttagtagagatgaggtttctccatgttggtcaggctggtctagaacttctgacctcaggtgatctgcctgcctcggcctcccaaagtgctgggattacaggcgtgagccaccatgcctggccacccctcagacatctaagaccctcacattctctctactctcttctgaactaaaacttgctctctgatacaaaggtatttgaggaaataaaataaccccccaaaaagtaaaagcttttctcttggaatagactggttaagtataggtaaggtttgcattgttaaggaaaactggcatttttaaaacggacaaatccagaaattaaaagactagatgccccaaagtaggaatttcaggcatctgagagggggccgcaaggttgtgtgtgtgtgtgtgtgtgcgcatgtgcatgcgtgtgctcccgtatggaggtggaggagggctctctagtatcttacaaatgacacagacatagatagctttctttgcctatgtctaaagtcggctcagctactttgttatgccccagattcctaggactttctgggagatgttaggcagagttctttttcctaaaaggacagaaaaatgaaaggtttaaaactaaaccctgactcccaggtaagatgcaacccttactgaaatagcactatgtcagcaaaacatggtctcattggctcattatcaggtgaggtcaggacattatttctggtagcttctgaaagccacagcctgttagaaaaaaaaaatcttcttcctgagggtttaatacagcttgctctcagttctcaggagcgctctcgctcgatccctctctcttttcttgggcctccttttaaaatgctaattaaatttacttgatctccactccgcgctccccccgctaattttggagatcaagaaagggagcttgatgtgtataatagatgtgcttgtctttccacctgagctacctttgtatttcattcccttttattacaggaaattgtgtcggggccctaaacactaacatacataacattgattgtattctgcataacaaattggattaggataattaccacacagatgttaaaaaatcctgaatgcaaatcaatgcaattagtcatgacttaatatactataattcacacattggaatgtcttattgtgattatactattttagaactaaatgcattaacaaaaaaaattcttttgctctgtgctgcacgtgctctgaacaagaaattgttttatgctaatctggaattccaccactcagaattcttattaactaatcagatccttcaatttctcttgccctcttttatatagagaaagccgcttctttagcaagacaatttcatgcgcaattcaacttgaatgccaccattatgaacaaaggaatttgcacacggatgcttttgacaaacatggctttagaaaactgagccttggtggtggggggaaagccctccccactgatggccagaccccaaaacaaagcagatagagtgtaagcaattggaatgggtccaagttagtaggcaaaaagcagacctgtcacaagggcagtaggctcagagctgccagaaagggttgtgcagcttgtacccagctgagagggtgagtgggggctgaactccagcctggaattcatgctccaagctgtgcaccaaaagcaatgctgtctctgaccccaggaaagggctccttttcctaattcacacaaaagtgcctgtgggtacaaggcaggagttcggtcacagagaaaaaataacagcagctgggaccccttgattctgaactgtgaactcaaatccaattcctaaagtcttttttggcttatcctaccttccagtgttctgtgctggcttagaattgcttagagttcaaggtgctcatagaacctgtgatctacatggtacactctttttgcctgtgatctacacggtatactctttttgcaattgttctgtatctgatttatgtcaaagctttgcaaacccaactgatctgggggacccttgagggctacgcttgtgccatcataatcctctctgaagtcctcccacctagggttaccagatgtagcaaataaaaatacagaatgccagttaaatgtgaatttcagatatataaaaaatgcttttttgcctgagcacggtggctcatgcctgtaatcccagcactttgggaggccaaggcaagcggatcacttgagtacaggagttcgagaccagtctgggcaacatagggaggcactatctttacaaaaaataaaaaaattatccaggtgtggtggcctgtgcctataatcccagctactcagggggatgaggtgggaggatcacttgagccccggggttgaggctgcagtgatctgagatcgcgccactgcactccagcccgggtgacagagacactgtctcaaaaaaaaaaaaaagcatttttagcataattatatcctatgcaatattttggacatattatattaaaaaatggccatttatctgaaattcaaattgaattgggtgttctgtgttttatctggcaacaccacccccaccctggcacaaagcgcagagcttcatgtttaaaataaaactaggccagcgtttcttacacttgagcatgtaatcagaatcacctggaggtgagtaagacctagagtgctggggccccacccccagagtttctgattcagcaagtctggagtgttgcctgaaaatctgcatttctaaaaagtacccaggtgatgctgcagctgatctggggaccacactttgggaactgatgctctagtataagcttaataaatagatccaatggggatgaggctgttgctcccaagttgacgttaagccagcagaatgcttcacagacctcatagcagggtttgtgggctccctggcaatgtttactcaaggtatgcatctatttagctctggtaacctcagctccctccctgtgtaatctctcttgattgcattcacttggcaataggcaaagttgtggtttgtctttgttgcatccagtcttgttttcactctgtcaatttttactctcctaccctcctccctgcctcttcaggtgccaatgtctttctagtctctaacttagggatggcaaacctacatgttgtgagtactggtgaagaaggactctacttgcttcccaagtaggaaagcaagcttttggaggtagttggccacttttagtgaacatattgattccctttgaggctctctttctttgttccaggcaagtcaccaaaatggccttttactgaaattgagatcaagatcctgaatttcagactgaatttctatttgaggcccaaagtttttgtaacatgttgggatgatctaggctggtcctggccaattccaggggttgggaaaaagcaataaaactcttgagatagaaggagacaggaccaagtggctggtctgtacactgggagtcctgaggtgcagggaggattgggggatgtttctgccaaatctctgaagctgctgctacgagaatccgcctcaacacagcccctccagtgggcaggtttaagccacaagcaaggattcatgtgtgggaaagagttggaaaacctcaggacgactttatcttgaaacatttgttgcaaccatgccccagcattcctgtgggtgatagtctagcccaggggccatggctgagtggtggtatccaggtgtatatctgatatcctatattctaagggaccccaagataaaggctgaatttcccatcaatatgggtttgtaaaaactcagtcatgctgggtgcggtggctcacgcctgtaaaactaggactttgggagggtgaggctggtggatcacctgaggtcaggagttcgagaccaacctggccaacatggtaaaacgctctctactaaaaatacaaaaattagctgggcatggtggcggtctcctataatcctagctactcgggaggctgaggcaggagaatcatttgaacctggggggcggagtgtgcagtgagccgagatcttgctacttcactccagcctgggcaaaagagcaaaactacgtctcaaaaaaacaaacaaaaaactcagtcataataatttgagcattaaaagaaatgtcaaaatatgtgtccaagtgatgggatgcacactacatgtgatacatatgtttaaaactaccttggtgaaaattataatagtgaaagagatctgatctaaccaactcttatcttgccgtgaacctccaacctgttcattcctgggtgtaggctgtgctaactataggaggaatttagtttatagtttaactttgaaacaaagatgatagctctttgcccaaacaaaggctctccatgcctcgggacgagactgcctttgtaaaactgacaaattagccacgcgattagaaagtatggtttaggagtctttcatccagaggccacaagattcctaacctccccagttgctcttctggataacatcactactgtataatctaacattggtgtttgggatacttttcagacaccgcattctgacggatcagctggcgccacccagaccagaaatctgactcaactagttcaggaactgaagacagcaagaactaccccttgactccaggtgatttcatccccaacccgaccaatcagtattctccacttcttagccccctgcctgccaaattattgttattattattattattaattttttatttttgagacagagtctctgtctgttgcccaggctggagtgcagtggcgccatctcggctcactgcaacctccgcctcctgggttcaagagattcctgtgcctcagcttcccaagttgctgggattacaggcacccatcactacacccagcttattttttgtattttttagtagagatggccagactggtcttgaactcctgacctcaggcgatccacctgcctcggcctcccaaactgctgggattacaggcttgagccactgctcccggcccaaattattcctaaaaaaccctagtctctgaattatcagtgagactgatttgagtaataaaactctgttctccagccctgcgtggtggctcatgcctgtaatcccagcacttttggaggccaaggtgggcggatcacaaggtcaggagttcacgaccagcctgaccaatatggtgaaaccccgtctctactaaaaatacaaaaattagccaagtgtggtggcgcgcgcctgtagtcccagctgctcaggaggctgagacaggagaatccgctgaacccgggaggcggaggttgcagtgagcagagatcgcgccactgcactccagcctgggcgacagagcgagactctgtctcaaacaaaaaacaaaaaacaaaaaacaaacaaacaaaaaaacccaccaccaacaaaaaactctgttctcctgtttagttggctgtatgtgtatgattaaactctttatctcagttctcctgtctcagtaaaccagctctatcttggcagcaggcaaaaagactcttgttgcctcccttttttgcatccatagtggacactgttatttgttcatagcctttcccacagagttttggtgtgccctttgaatccttctgttagaatattcttggttgcaagtaacagaaaacaaacttataaataaatccttacctagcatttactatgtgccaggcaggggactaaagcctttatacattcacaaaatttacagatccttttaaaccagccatagaaggtagagtagttatcccaattttacatattagacaaaaaggggatttttattctttttcttttttctttttgttttgagactgagtctcactctgttggccaggctggagtgcagtggtgcaatcttggctcactgcaacctctgcctcccgagttcaagcgattcttgtgcctcagcctcccaagtagctgggattacaggcgcccagcaccacacctggctaatctttgtgtttttagtagagatgggatttcaccatgttggccagactagtctcgaactcctggcctcaagtgatcagcccacttcggcctcaaaacgcactgggattataggtgttagccactgagcctgaccctttttttttttttttctttttagtagagatgcagcgtgtctcccaaaacccaagttcctgaatataggtgaccttcaaagataaactggaccacaggataaacacaatgtggattctctctctacttcttgcttctgcacccctttgttcctgtgtttcattcttctttctatagaccagctttttcttgtccatatggagaaaaacatggtaggtaacatcacctgggttttacatgttatggatttgaccatccacagagaggagctgagctttttttttacagtagcttcacagtattttattttttctttattttttttaaatggacaaaattgtatatacttatggcatattaacatgatgttttgaaatgtgtatacattatggaatggctaaatcaaattaatatatccattccttcacacacttatatatttgagatgagtacacttaaaatctattctcttaaaacattttaagtatacaatccattgttattaactgcagtcactgtgttgtacaatatatcttttgaatttattcctcccatttaactgaatttttgtatcctttgaccaacatctccccaataccttaccacccagcatgtggttaccaccattctgctctctgcttctattagtttaacttttttagattcaacatataaatgagatcaggtggtatttatcttctcagagagagaaactcccttccttccttccttcctgcctgcctgcctgcctgcctgcctgccttccttccttccttccttccttccttccttccttccttccttccttcctccctccctccctctctctctctttctttctttctttttccttctctctttctctctttctttctttttccttctctctttctctctttctttcttgagtttcgctcttgtcgcccaggctggaatgcaatggcatgatcttgactcactacaacctccacttcccgggttcaagcaattttcctgcctcagcctcccgagtagctgggattacagccgcgcaccaccatgcctggctaatttttgtatttttagaagagacggggattcagcatgttggccaggctagtcttgaactcctgacctcaggtgatccatttgcctcagcctcccaaagtgctaggattacaggcatgagccaccgtgcctggctgaaacttatttcttaatttaaaaatcccctgggaagagatttcttggctcaatttgtgttaggtgtgcagccctggatgcattctcctagggatcaacctttactgacccaatgcaacttgcgaaagagggatataaaaaccatggacagagggctgtgaatctcactgtagaaacatgccgttccctcaggcactgaatggatatagaagggaagggaaaagcccttgaaataagtattgggaataaaatacctgcccacaacaccttaacacagcatcccatctggtttctgccaagtgatcagaattgatacacgctactatttgtcatctctgccctggctgcctcctatcagtataggaaattgatgtggtattctcatttgtactgactgtattggtccaaggagaagatccttatatctgtccaagttgcacaccccacccccaaccccctttccctggctttgtaacgccttcctgctgttatccactacttcttgacctcatcctgtatcatcctgtaggagaactcagtcaactgattgcacttctaagaagctttttctagacatggtgccagagctgttgtggacaaggaaattgcccttgaggaagatgtggcagttagaggagtgaggcaggatggctgtgtcatcaagaaagtttgtccgacaatttaggcaggacctcacagggtactggttagatccagaagctgaattttgtcagagatacttagagatctgtaatctcctgggcatagactcatgctaaccaatgtaaatcacaagggatagagatattaatacaaagctataattccaacttattttcaggagtacagagaactattaatcaggctggagttggcatgtcagctggtcaggctagacctgaaagaaaagctaaatgatagcagaagattgtttatggagcaaggaatgaaaactaggagcagttccttggatgatcttaatggcatctgccattcacctgtgacagccccacccttgggatagatcaaagaggagagacaaaatactcatatttgtatgtgaagatgagctctcctggactagttgagcaacatgttgagagtttcttgttctttgactcattttctagatctctatccacacttgcctctactttggttaacacatctatcttaagcctcaaattatcaagctattagcagtgttacctcaaaaccagagttctgagaaaggaacattgttctgcaggatgataattgatgtttttcagttaaaaatgtcttttacatggtcgacattgagttaaataggtttctttcccacaggatgtctgagagcctttagtgaaccaatatacactgtgaatttccaaaagaagggtagaacctgcaaatttatttgaccacttagttgtatttttcaaaagaagttatgctgagtgaaacaagccaggcacagaaagacaaatactgcatcatttcacttacatgtggaatctaaaaaagttaagcccacagaagcagagagtagaatggtggttaccagaggttgggatagggggcagggatagaggttgggataggttggcattagaatggggagatgttgggcaaaggatacaaaatttcaattggacaggaggaataagttttcaagagctattgtaaagcatggttatcatagtcaataataaagcatatttaaattgccaaaagaataaattttaaatgttctcactacaaaaaagtatatgaggtgatagaaatcctaactaggttagtataatcatttcacagtgtgtacatatatcaaagcatcaccttgtaccccataaatatatacaattgttatttgtcaattaaaagtaaacattttaaaaaagttatgagggagaatgtcttagtttcctatctctgctgcacaaacttgttggtttaaaacacaattttttattttacagttctgtagttcagaagtcctgaaatcaaggagtcagcagagctgtgttccttctggaggctctagaggggaatctatttccttgctcttcccagttgctagggattacccacatttcttggcttatggcccctttcttcatcttcaaagccagtgacagcatatcatcttcaaatctctctctctctctccctctccctctcctcccctcaccgcctctctacctcccacttcactgcccctcccttttgctctgtcatcatatctctaccttctgactctgatgcttctgcttccttctgttataaggactcttgtgattacatctgtcctactagataatccagataatcatcccacctcaagatctttagctcaatctcatctgcaaagtcctttttgccatgtaaggtaacacgttgataggtttcagggattaggatgtgaacctctttggagagagttatcatttgacctaccacagggagcaatgggaaatactggactatggtattaaacatgctaatacaatcatactctactagggttatgctagtgtcaaacctgatcagatttggggagttcctgacatttctcagatacctctttagaggctggagttggcttctacactaccgacaagatctaatgttctctactggtggggcagtggcagaagctcctgaagggagaaggagcaagggcttgtgcactgaagaaggggattttccccaaagcttcttctcagaaacatacccttctcaaaaagaccaaagtcatgcagaagaattccgtggcagtgggttaaagttacctgtttaatcgaaagtagagataacctatcactttcatttcaaatggaaacctgggctccagaatgtcttaaatgacagtgttaccaacctgggaaaccccccgttgactggtgagcaagaaagtaaggctgaaagcaggcgatctttttatgccacctaatgtatttatgacaggtgctctgctgtgtttggagaaatggacacccgaagttttcggctttcctgcagagaatatgtgatcccttctttctttctctaaggatatttaactgtatttcatgatatgacaataataactcttgactttgatatagtttctgctaggtctggggtcctcagaactgactacatcaccagaaataaaactgaagactagataggggttattgagatcccattaaatactgccttggataagaacagtaatttcagcttaagtgcttgattatgctgaagattctattgcagagtatgagtaacttagactgagaaataattcctcatgtggttttggatctgcttgggaaaatacataccagaggtttccaggcatctctttcttaccaaatctcaatagcattttcttcactcccatgtttttctcatccccactgacactgactaccctaactttttatatttttttaatattttggcttcagtggtccagccttatactagttttccttctattcttttgaccacatctctgctttatttcctggctcttcttttttcttctttgttataactggattctcctaaagacattctcatggacactctcctctttatctttatatactctttcgtcaatccatccattaaacatttaaaaagtatttaaatatttatgtttggagacctgtattgtgctctggggatagataaacgtattagacacaatccttgccttctgggagctcaaaaactggggaaggagacagaaaatcaatgaaaatagtatagtgtaatatttagtatgaaatatataggacatgttttatggaactccatggtaggggcatctatatatttccagttgggttgctttcatctagaaataacagaaaattcaaaatgatttaagcaatgaggataaatatttctgataacaagaaatgtaaagccacagaggttccagagtttgtcaattcagtagcttaaggacatcattaagaacccaagtgttttccatcttttcatctttctcatctgctatcttaagcaaattcctttcaggattgcaagaaagctgcagtggttgcaggcatcacatgtagaaatgataatgttcaccaaagaaaaaggtgttacttgcagtgaatttgattttatgaaaaacctatttttttttttttgagacagggtctcactctgtagtccaggctggagtgcagtgacatgatcatggctcactgcagccgcgacttcccaggctcaggtcattctcccacctcagcctcccaggtggctgggactacaggtgcatgccaccatcccggctaattttttaaaaaaaatttttgtagagatggggttttgctctgttgcccaggctggtctcgaactcctgggctcaagcaataccgcctgcctcaggcctcccaaagtgttgggattacagatgtgagccatcgcgccccactgaaaaacctctttttgaagcctccactcaacttctttcaaggacccattaactaggattaccaattactggcaaagagaataaagatgccttgattgattggtttagatcaggggatctcagctttggctgcacgtgagagacacctggagggcttttaaaaagctcatgcccaagcatatcctagagcaattaaatcagaatctctgactgtggacccagggatccacattttaaaaactccccatctgattcccctgtgcagccaaggttgagaactattggtttagaccaatccctctgatttgtgtctctggagagggaagagctcccagtctccctttaagaaccggagtgactgctataggagaaaattgagattctatacgcaaggaagaaatgaggaatagctttttggtgggcaaatcacaatgtctgccacagtgactaatcaacattcatgatttcagttagcatttctgtgaggagactgatgcttctagctttgacctcgtctgagtttcaactgtttcctggcatttctacttggattttttcatccacacctcgatgtcaacttgttccaaaccaagtgttccagcctgctgcctctcctgatgacattattttcataacatgctactagcattctcaggatatttcaggctcaaattcttggaatcttttcttctctgtctcctttacgactatttaaaaagtcgcctcaccctgttttcattttgttttctggagatgtttttattccactgtactatatcctcttccagactggttcagactgcccttgcagcattgtatacttgcattctgtaacagcttcctagctggcttcctgattctagccttaaaccttttcagttgattccgcatatcacttgaacgagtttagacatattgtagacatcactgtagacatagtgctaagatactgctttcattatgtcactctgcacaatgccttttgatggtttccaaatcctacctgttttcagggtcctccaaatttcagggttttcccatctattaaggcctggttccagccctagttcctgtaggaggcattttccatttactccagacctcttggatccacacagatcttggttcaactcctgactgttacgtaactacctgtgtttccttggcaagttgcatatgctttctgagttttagtttcctcatcagtaaagtgggaataatactaggtgtttttttttttttgagacagagtcttgctctgtcgcccaggctggagtgcagtggcatgatctcagctcactgcaaacttcaccgtctgggttcaagcgattctcgtggttcagcctcctgagtagctgggactgcaggtatgcaccaccatgcccagctaatttttgtattgtttgtggggatggagttttgttatgttggccaggctggtctcaaactcctgacctcaaatgattccccctggccttggcctcccagagtgctgggattacaggcgtgagccaatgccccaggccactagttttcatctcatagggttattatcaggattaaatgagttccttttctccctgccttttttctgacatcttatgttgcctactttttagtacataatgtagccttttattatctaatgccctgtaccctgggctcattgttttttgcatgtaaatatcttttcactacaacttgacagacaagctcttttaaggaaaggcgctgtacttgccacttttcttgtgtgccctcctgaattctgttgtatgctaagcccatatagaaggtattccacaatgtttgtccactttttaagtattaagtagcacaaacaaaaagtactataggagctgggagaacaaatctgtctgcagcttaaggagatggaacttctgttcagagttactttttgctgtctgcctttcagtcagcagcctccctgcttggttcctggcactgagtttcaggtgatctcatttggatagaagaatctccatcccagttttcattgctttcactcttggagcaaggtagagatctgacttctatggcactaagcttgcattcagtggcctgttcatcatatcagcaaaggctaatgtctttgtcttctggtagggtagggtgattttctcattggaagctccatttgggtgttgctttctaagtgttaccaaagttgttgcaaggtgttaatgcaaatgaggataaacaaaagtgtgactctttcttggagaaaaaggtatcatatattttgctctgtggcttcacatggttttgggtgtttttgttgttattgttttgtttacttgtttgattctcaaattgtgatattcctcttccctgtaacccgtttgaattggaatctacatcactgggagttgggaaaaaaaagccttgggcagagaattagaagacctgagtttgtttgtagctttagccaagttagtccttcttattgtgcctcagtttcctcatttgcaaaataggaataatgcctgccctgcctatttcacattgatgtggagagaaaagatgaccagctgcataagcatgcttaggaaagtgaaaagcctttacaaatgtgaggatgtatatatgtatgtatgtatgtatgcatgtatgtatttatttatttgagatggagtctcgctctgtcgcccaggctggagtgcagtggcgtgatctcagctcactgcaacctccgcctccccagttcaagcgattctcctgccttagccaactgggtagctgggattacaggcatgtgccaccacgcctggctaattttcatatttttagtagagttggggtctcaccatgttggtcaggctggtttcaaactcctgacctcgtgatcccacctcagccttccaaagtgctgggattacaggcatgagccaccgtgcccggtcggatgtattcttttaaacggcatttaaacacaatctggcttcaagggaacattctttaaccactgggagttgatagattttgcttttgttattaaggataacacttatattattgtctaaaggtatttgatggttttccaacccttcttccagtgtttatacttatgtatgtgtgggggtggtggcaggcttccaaaaactgtattccatatgattttaccttatcatagggtcatatatatgtggtttatatgaaaattcttatttgcattataagtaatctcccttccacggttcttgtgggttttaatgattcataattaaatttattttgaaatgtaataatttccattctctgaacactttaccatgtattaaaaactggccttagtcaatttgattttatctatgtttatttatatggagataatggtagtcattaaaaaagtttgagatgaattgggattacttactttattgcaatctccctacgaagttataatgaaagcaagtctcagaccaaattttgtcttacacattaacatttattaaatgaacattgattaatagcagtaacaaaagagctcatataaacagttttttaaggttgatgaagtcccagctctctgtccttttaaaggcttttaacaaaacatacctcaatgagtcacaggaggaaggcacactcacattttagaagcagaatttttaaaaatcttgtttttggtcgagtgcagtagctcacgcctgtaatcccagcattttgggaggccgaggcgggtggatcacctgaggtcaggagttcgacaccagcctggccaatatggtgaaaccccgtttctactaaaaatacaaaaaatttagctggttgtggtggcatgcgcctgtaatcccagctacttgggaggctgagacaggagaatcacttgaacccaggaggcagaggttgcagtgagccgagatcacgccactgcaatccagcctgggccacagagtgagacaccatttcaaaaataataataatacttttttattgaagtaacattcacataacataaaatgaaccattaaccattttaaagtgtacaatttggtggcatctactgcattcacaatgttgtataagcatcaccactatctaattccagaacatttaatcctaaaaggacacttcgtacttattaagcagtgactccccattgcctctcctttaacctctggcaaccactaatctacttactgtctatacagatctacctattctaaaagtttcttataaatgaaatcagagaatgattttgtgactgtcttctttctcttagcataatatttttaaggttcatcatgttgtagcatttatgaattcattattcctttttattttttaaaattttatttttgagacaggggtctcactctgtcacccaggttggagtgcagcggtgtgatcttggctcactgcaacctctgcctcctgggctcaagtcatcctcccacctcatcctcctgagtagctaggaccacaggtgtgcgccatcatgtccaactaatttttttgtgtttttgatagagacggggtttcaccatgttgcccaggctggtcttgaagaactgttgagctcaagcagtccacctaccttggcctcccaaagtgctgggattacaggtatgagccaccgtgcccagcccattcctttttatgactgaataatattccactctatagacataccacatttaaaaaattcattcattcactgatgaccatttgggttgcctccacatttcggctattatgaatagggttgctatgaatattcatgtgcaatatttgtttgattacctattttcaatgattttggatatatacctaggagcagaatcactgggtcatatggtaattctatatttaatttttgagaaactgctaaactactttccacttggctgcaacattttacattcccaccagcaatgtgtagggagctcccatttccctacatccccaacaacatgtattattattattattattttaaatagccatcctagtgggtgtgaagtatctcattgtggttttgattttcatttccctgatgactcatgatgttgagtatgttttcaggtacttactgaccatttgtgtattttctttgggaaatgtctattcagatcctttgcactcgccctcaactttcttttttttttaagagacagggcctcactctgttgcccaggctggagtgcagtggtgcaattatagctcactgctgcagcttcaacttcctgagctcaaccaatcctcttgcctcagcttcccaaatagctgggattacacaccatacccagctaatttttaatttttttgtagaaatggggtctcaccatgttgcctagtctggtcttaaacttctggcctcaagtgatactcctgccttggcctcccaaagtgctaggttgacaggcatgaaccatcacacctggctgtcttatttttatttttatttatttatttttgagacatggtcttgctctgtcacctaggctggggtgcagtggtatgatcatggctcactgcagcctcgacctcctgggttcaagggatcctcccacttcagcctcccaagtagctgggagtacaggtatgtgccaccacgcctggctaacttaaaaaaaaatattttgtagagatgggaatcttactatgttgcccagactggtctcgaactcctggcctcaagcaatcctcccaacttgacctcccaaaatgttgggattaaaggcataagcgaccatgcccagcctgccctttttttgttttgagataagatcttgctctgatgcccaggctggagtgcaatgtcatgatcacagcttgctgcagcctcgactttctgggctcagacaatcctcccacttcagcctcctggatagctgggaccacaggtgcatgccaccactcctggctaattttttgtagacacagggttttgccatggtgcccaggctggtctcgaagtcttgggctcaagcaatctgcccacctcagccttgtgaggtgctgggattacgggtgtgggccaccacacctggcctctggcctgcccatttttaaattggattgtttctccttttgtcatggagttgtactctttttattcctcaatccctccattgctgctttcttttgtgattagctgatttctttttctagtgtataattttgattcccttttcatctcttttaaaatatagtttttagtttttttttcttagtggttaccatggggataaaattaggatcttaactctataccaatcaaatttgaattaatactaacttagtttcaatagtatgcaaaaactctgctcctttacagctctatctccccattttgtgttatttcacaaattccatatatatagtatgtttattaacacagttttgtaattattgttttatttctttgtcttttaaatcatatggaaacaaaaaagaatgacaaagagaaaaaaggaggcattacaaattgtatatgcaacaccaccagcttttacaattacccgtgcaactacttttccttttgttctttatttcttcatgtggatttgggttactgtctggtgtactttcatttcaacctagacgattcttatcctattgcgtgtattgtacaggaagtctatttgtgatgaacttcctcaagtttttgtttatttgagaatgtcttaaattttccttcactttttgcaggatagttttgctgaatatataattattggtttgcatttttttcaaaaatttaaatgtccaactgcctccatggtttccgaacataaactgttagtcttattgaagatccctcacatgtgatgaattacttctctcttggttttctgaagatgctgtctttgtcgttttttacaatttgactattatgtgtcttggtgtggatatttttgagtttttcatgtccggattttgtcataatttttggatgtgtagattcatatttttcatccagtttgggaagtttttcattgttatttcttccaatattctttctgcacctttctgtctctcctcttcctctgggaacctgcttattcatatgttggtaaacttgatggtgtcccacaggtctcaggttctgctcatttttcttcattcttttctctttctgctcccttgactgaatgatttcaactgacgtatctttaagttccctgattttttcttcacttgttcaatcagctattaaatctctctagtgaatttttaatttccatttctatttgtttcttttaaaaaataatttctatctcttcattaatattttctattgttttattggtttcctctaggtttttgcatatagctgataagtcatttaaagtctttgtctagtaagcccagtgccagggcttcctaaggagtagtttctttcttttattttttcttttccgtagatacaccatactttcttgtatctgcagttcttgtattttttgttgaaaactgaatattttgaattttatagcatagcaattctggaaaccagattctctaccttacccaaaatttgtttttgttaccgattgtgggatgctgttacttctttagtgacttttcaaaactgtttttgtaaagtctatattctttgtcttatgtagtccctgaagtctctgttctggcactctagtggtcagctggtgttttgatagagttaccttaagtgtctggagcaaataaaagataaaaggaagagaaaataaaaaagaaaaagaatgactctcccagtctgtcattgcagattggttctgtgttggggtgctccttcaatgcttagccaggccatttatctctgtcttagctttcactttctactttcacagaacttagggctagccagaggttaaagcttaaagtctcctcaggccttttctgagtatgtttcccatacagggcatgtatatgtatttcttgattccttggtatacacgagagctttttaaggcctttattcccacatgtggctcctttcctaacctctttctttccaggattattgatctgcctgttgcttgtcccaaatgcttttccttgccccaggctgttgtagctggtgcctttataagcttttgtctaggaaactactctagcattgggaactctctgaattggacaaaataaaaggtaacctttgttctggtccatgagaaaaatgccagacaaatcaagactcaattctttgagaataaggtccatattgctccctttggcactggcactggctattggcatcagaggtatgggccttggttcacatggccactgccaatttggtgtgtgaagaatggtaggcgggcaatttaaaatagcactgtgctcttttacctcaaggcaatcacttctttctcctggagtgcggtggcgcaatcttggctcactgcaacctctgcctcctggcttcaagcaattctcctgccttagcctcccgagtagctgggattacaggcgtgcaccacgatgcccggctaattttgtagttttagtagagacggggttttgccgtgtcggccaggctggtctcaaactcctgacctcaggtgatctacccgcctcagcctcccaaagttctgggattacaggcatgagccactgcgcccagccaagaatacttttaaaagaaatttctgaatgccaaatgttctttatggttggaggctggcccataagtagaatatggttagattgcttcattacctgtctttggttcttttagaagcctgctatatagcaaatctcaagtccaaagagcatttatgggaactcacaggagtggtctttgttggaggtgtccaggaagatctacacacctccaaccagtgtggctttagtgcttgtgtggtctgagattgggccataaattgaacttgagcctcattttttccctccagccccgccactggagtacaccactgcctgctcagaattttagtttctcttgtctgtcacaaggccctaggaatgtagagaagataagatgcacttttgcgttcaatagaagtggagaagcatagccatttaggaaagcaattagcgattgatgactggaagtagttggaaacatgaattcagtttttcccttgtagtatatctcatatcttttcttgtagtatagctcatattgtggcttaatgggccaacttttcacaggctctggaaagcatattcagctttctagtaacattttcaagttaaccccaactgaagatgtggtcatttacagaatgagatttgaggaagcagctggcagtatacttctccctccaagttcactgccagtcattccacaatttctcaatttctttgtgccttcaggaaactcctagcaaaataccaagttcagtatgggttctactaaagtcttttcagagtagactcccctgaaaagtgactttctttccttttcatcaacttttggagagcagtcaacagcatggggaccatcaaagttacactgagggaaatgaggatatcagaaactttccagatggcttgaaatgaatgcaggtgtgcctggaactctgccattgctcctcatcctgaaatggtagtcagtaaatgcacttctggtaaacaattccaattttaaatgtgtcagtggaatatgccagctaaagaaatccaggaatgaatctgtttgttcagcaaataagtctccctgtttttgaagtttgcatttttattgaggtttcttagattcttaaagtggtttcagaaagtttcatcacaaaagatatttaacctaagtagacaagctgatttagatggtgagttgtatgcatatatggacaaaggaggagagaaggggaaagatttgtatagatgggctatggtgtgtacacatgtgtgtgtatctggcaggtagaggtgactaacatttattgatgtttactatgtgtcaggaactacactaagtgtttttcaggaaccattttttttgactctcatgtcaactctgaggtagatactattattctcctcttactgcttagagaggttaagtaatttgctcaaggtcacagtagaatggagatttgtttctaggtaacaggagaggcagttctagctgtgggaccttaggcaagttctctctctctctgggcttcagtttcctcatctgttaaatgaaaggttgtctttagagtacttctggctctgacagtctataattctacatttctgggctgcttcctatgttttctgggtgttgtttcctaaggagagaaaggccagaagtcaacaatgactgacctgctagtagggatatttcacaatgttgtcagagacagcagggtaccatggacaatacatttgtttgggtttttgtgttgttggtggtggtttttcattaccttgatctgagttctggacgctattaaaacacttcgttctcatcattaacttctgtcttaagaaagacggaaacccagaccatttattgtaatttttccctgactacatttttatttttcagtgcttcttattttcccaaagtgctgtccctgtgtgttccattcatttaatgacaaatatttatcgagtgtctactatgtgcaaaatatttttctaggcactgaggatacattgatgaataaaacaggcacatatttctgccctcatggagcttatattttagtgtggtgaacaggaaatgaatgaaagatagtcattcaatatacagtagtatgttaaatggtgataaattctatggtagaaaatagagcagaatgagggacttgggagtgctctgtacaattgcttactatgtccttgggaaaatcagtgctagtttttttttttttttttttttttatcagagcatggataacaggacatttcttacttaggcaaataagcatagactttggagttagatagacctattttgatttgcgaccttgggcaactgtatcccagctttgcaaccttgggcaactaattttcattgagccttgtatcagccagtgttctatcagagaagcagaaccattaggagtgatacaaagcaaaggatttattatggagatcagatcttatgtaattgtgggagctgattaaacagttcctgtaagtctgttgttctggggccgggcacggtggctcatgcttgtaatcccagcactttgggaggccgaggcgggtggatcccctgaggtcaggagttcgagaccagcctggccaacatggcaaaaccctgtctctactaaaaatacaaaaattagccgggcatggtggcgcacacctgtagtcccagctactttgggaggctgaggcaggaagatcggtagaacctgggaggcagaagttgcagtagctgagatcgcaccactgcactccagcctgggcaacagagtgagactccatctcaaaaaaaaaaaaaaaaaaaagactgtcgttcccgatctgatgctgggcctgaagtcagcagggcagatagtcaagaaagatggatgtgaagtgggaggagagcaaggtcacactagaacttatgaggattagctggaacccaaatatacctctcacagtctctaagcctccaacttcaaacttggaggtatcatgcaggagaagctggtatgcttcatcacagagctaaacacacacatggcccctgagtcagagaagctgaaggaggaaatcccaggggaactagagaagttgtggcctatgtgtgttctctcagaaatcagagaagctggccagacgtggtggctcatgtgggtaatcccagcactttgcgaggctaaggtgggtggattgcttgaggccaagagttcgagaccagcctggccaacatggtgaaaccctgtctctactaaaaatacaaaaattagctaggtgtggtggcacgtgcctgtagtcccagctactggggaggctgaagcaggagaattgcttgaacccaggaggcagaggttgtagtaagccaagatcatgccactgcacttcagcctgggcaacagaggaagactcttcccaaaaaaagaaatcagagaaactgaaagaggagctttagcagttgctgtgggctcagacatgccccaagccaaagttaagagccaggagagaagagacaacatacttaagctgcaaccataccaagtaccctcctctgatcttctgggcctaagaagatgagggtagctgcttcacttctgcctcccgagtttcatgcaacatatatctggtggtccatgctaacccagcctatttagaatagagaagggaattgtagagattctagttccagcttagcttggttgacagtgtacaaatccatcacaagccgatatcttaatgggaataataatacctaattcacaggatttttgggaagaataaatgagttaatctgtgtaaaagtatctagcacatagtagataatcaaaattttttttctttctttctcctactctttggccaaggaatagcataatttcaggcctcagggccgtgaagattttacgtatttatttactgggggaaggtgctgtggggactgtgaggatacctgtttaaattattaaatgattatatcagattgcaaattacttgttataactatatttgaggttgactctgtttgaggatgtggaatatacactgaatgccccaggccattgaagatacatttagcatacatacatatacaaacaatgaaaacagatagaaagaaatcatataaattggtggaaaaacaaatttaatttatgaagtcacagagtcaaagaatgtcagacctggtaggagcttaggaggaggtcaaatatttcaatacttaattttcacagatgataaactgaggctcagagaggagaagtaaattgggtaaattcactacttgtttggtccagaaacattttttataggatttttttaggatcctatagaacttgttaaatatattgtaaggatattgttgaagacttcagacactttattattcagtatcttctatatgacatccccacatgagaaattttagaactaagtgccaggaaaaactttgtttaacccgaagaagtagtatgcttttattcctcatggacaatataaatctggtaaatgatcatgaggaaacatgatcattttgctttggctgccaggatgttcagagccaaatttgtagccctaactttactaaccatgtaggtctctatgagcctcaatatagatgtcttacctttgcctctggctttgttgctttttttcttcttgtcttgatttttagttaatagaatttttatatttttagttaatatgatttttatatttaatgtgatatatatcacattatatattttatatatatataatatatatatataaaataagtggcctcaaattctttgtggtatgaggaaggatataaacacacaaatagaaaaatcctatattatttgacctctgtggtgcagtgaaaaagcactgggcatggaataaattctagtctaggctctgccattttaatagacttctctgaacttcagtttctttgagcagcttggatattgtaacttctggtatgattcagaagacagcctttttagaagagtatagaagtgtctaaaaccttgtgtgtctgccccttatataaaaagtgttttggggaacttgactctcagttaagagattcagggtgatttgaaatgaggattttactcaattctggataagagaccagagttagattaagtttctagattggtgagagaatagtacataaagtagaatgtgttcatttatttgcttggatttttattttttttaatttaaaaaattatacggtaaaatggactttttggtgagtacgcattctatgagttttaacacatgtatagattcacataaccaccacaagcaggaaacagaacagttccatctcctcagaaaactccctctggctctccttttatagtcaaactctcctcccacacatatgccttgattttatttattttaaaatgtcctccccaacattttatgagaatagattaagataaatttgatgcagccattcactttatagagttcctactgtatgctcaccactgtggtaggttctgcaggctgtgtaaggagtatcatatgtggaccagggcttcaggtatgttacagtgtggttggcaaggtcagcttaatacattggaaacaattagaggagcctataagacactgtataagcaagtgttaaattggtacagatcagaagatggggaaacatctgtctgtgtttgaatataggcttctgcaagcgaatgacacactactcatatttgtatgtatctttctgtgtgaggacagactgaaatgtatttagaaatgtagagttaagttttacctctaaaagggatatattagtctaaacagatgaaagagaatcacaggattgtgagagtatttacaaaagtcttcagaatctatagtcaaggaagtctacctaagtgcaaaaaactattttatttttataagatgtggagagacagatgattgccaaatggctttgctctgtgtccagagaaatttaacgaagctgacagccagatatctattgcagaagtctgactagaattttccattatgaatacagtgcatgtgaattctgaacatatggcttccatcagtgatctatgaggaggtgatggaatgtaggttggcgaagacaagaggaaggccaagtctctgactctaaagtgagaggcagctggaccccatatgtgtgtatgtttagagttggagccagctttatgtcaagggagtaggcagtcacccaagcctcatgatttgtagggtgtagagaaaggatcttcctttgccaaattctttccctacaggcaagccccaaagcctgaactttccattagagaaagaaacaaaatattgtgtcttccaaagcccctctttaaaatataaggagctgggtagggggtgggacaccaacccattaaactggaaatagctatcagagtcttgatgtagagcagtttatctaataagcctagtgaaactggagggaagagtaggacccatgagatggggtaggtctgtgtgtctgtgggtgtgtgcatgtgtcttcatgtacacacatgctgggagtcagtgtgtttgcagaaaacctggcccccatacagattagaatggtaatattgagtgcacatttacatattccagctcatttgctacatgttgggtgcctgcaatggtttactctccaaggtggcaggcctccctggtatcaaccaggatacaggttactgcagagatttgttaagaatcgattaagaagacaaccttctgaggtacccttggcctgaatatctcgaagggccttttaagacaccttccagccagccctcgcagaaagtgggggtaaagtcaggagtgtgaagcccatgacatgaatggagagaatagctattaaagaagttgtcacttctctaaaaataacctagatatttagggtacaagcaggactgtctggtgtgtatgtgatgagagccagaagccccaccctttctgagcaaatgaggtgatatgaagagcagaactttctgaccatgtcctttatacctgacaccctaggtatggtcctgtcttgcatcctgaaaactgtccttacttctcaacaaaattgcttctggagtcctcttttcaagctatttttagcaattagtccaaccttgctaagctgtgaaagcacataaagcttatttttcttttgaaaatgaaggaaaatgtattctaagaagctatgaagatgtgcaggatctcactaaatgttagatttgactatttgaaatgtgcaggactaatcagttcagaggattgtccaacccttggaatatggaagagcattggacctacagagaaggagcttcacaaaacttaaaatctagtgccaaaatgtctgctgcattcattgatcctctttgacatcaaagtgttaatttggccgtgtacggtggctcacacctgttatgccagcactttgggaggccaaggcaagtagatcacgaggtcaggagttcaagaccagcctgaccaacatggtgaaaccaaacccgtctctactaaaaatacaaaaaaattagctgggcgtggtggcgcgtgcttgtaattccagctactcaggaggctgaggcaggagaatcccttgaacctgggaggtggaggttgcagtgagccaagatcgcgctactgcactccagccttggtaacagagtgagactccgtctcaaaaaaaaaaaagtgttaatttatcttacaatttggtgtgatttcggtaattatataactgagccttttgtattaaaaaggcaagtactttgcagattggtttggggtggagaaaatcaacaaaaccccatgtgggtgtggtgctggcttttctgagttcattgttggacggaaaattcagactacttctcagcctgagtcatctgaaaaaattggatttgctaatttgcaggtggaaaatgtaatgtgcctgttaatttcttcagatgatgacatttaaaggtgaaagtgataatggtgctggggaggtgtacctggggatcatgggctttatggtgctgggtcagagctgccattgaggtcaggtgaattggctttggtcaaagggcagaagccagggctctagtataatttccctgtagactgataatggaaatttcccattacaacttgtgggcatatgatgtaattggagattcataaatagatttcttgggccctgagacctactttctgttggccaaatttgtgtttgtaacttttggatggtatccagcaatggggacactaccaactttctcaatagcctgttccatttttagagaggccaagaaactcttatttctagccatgctgctcctacttaaatctacccatttcttcttggtcagtgtttcatttacatgagaataacttctcagcattgttctcttcaaattccttcatggactattggaccacactcctcaagtcttctctaggctaaataactttctgtagtgataatgtaggcctttctcaattcactcataaagaaatgagtctttaggattcttgcttttacaataataacgataacaataacaatagctaataattgccctttctttttagaaaaagctgacatttatggagtgcttactaattgccggccagtgtactaaggattttacatgtgttggttcattttatcttcctgataacccagtgcaggtacgagctactattttgctcttttaaagattaggaacttgaaagtgagagttaatttgtccagttcatactgtaagtttaacgagtatctttctgtgatgctctatgtcttccctgatcattgagattattctggcttttttgtatttattgttcacatatgtctgtatacacacacacactcactctcacacacatacatacacaaacatatgggaaaataagtgtgggtaaatttgctagatgcatgtcatgctgccttgtgccatgccaaggtactaacatctttaaaggaaagagtagctgaccttcatctgtactgaaattattcccttaggaatatttcatttctcttttccattaataagctgccttgaagagcaaattagttcggtgaaggatgctacattaagtttcaaagtgctagagccaaaggaattttaatattttcacctttattctgtccacatatgttgtagatgataaaattctacagcaattcctactgtgtgcattgcctctcagacctagaggctgtcaggtgatggctaagaggaaccactgcatatcccaagtgaaaggactactgtataggccactttgtagccctttacagtctagtaggagaaatgggcataagcatatgttgtaggtgagaacaaaccatgctgcgtgtggtacctgtgtactacatacattttgagagttgctcctggccgttggaggagagagtgaagtgtacattttcaggggatttaatagtgcctgaaagttcagaaatccaggatgtggcatttggttttggatttgaaggcaaggaaccaaggaagagtagaggaattcctgaagtggaattcattagttttgtatcggaattgagctgccagtcacagattggcactgctgtgtgccatgatgggctggaggcagaaggaagagcagcaagacttggatcctaaacctgtctttgctactttggaggtctgtaaccttgggcaagttaaatcgtacctctgggcctcagtttccccacttgtaaagtgagcacaagaccatatgtacctcataggcttgtaatggttaaaaagattaataaatgggggatggctttgagtctagaaagaaaattagaaacgttagccatcactaataattatattttagatgtactctagacgaattttttattagcttttttctttcaaaactaagtctattactttcccaaatatgtctcacagtatggaattgaaaaatattgtttttagcacatgatagaataaagtttagccactgatcctattttgcctcctttagcccaagctctgagcagacttgggatggccttcccctggttggggacaaggaatgagtttctcaactctttttttttttttttttttttttttggagacagtcttgctctgtcatacaggctggagtgcagtcgtgcaatcttggctcactgcaacctcagcctcccaggttcaagtgattctcctgcctcagcctacccagtagctgggattacaggcacgcgtcaccaagcccggcaaatttttgtatttttagtagagacgggatttcatcatgttggccaggctggtctcaaacccctgacctcaggtgatctgcccaccacagcctctcaaagtgctgggattacaggcatgagccaccctgcccgaccattagtttttcaactcttaaattaatgcactgcctgccactcacctactcatttggctttaattctcatggcttgcccttaatcaatagcttaggacagtggtttccaaagtggggatgtatggatccacgggggttgtgcaagatgatctatttgggtgtggagaaaacattaaaatttctatttactttttctatttttttttttagagcccagggtctaagaaaaacaaaacaaaacaaaacaactcctgggctcaagtgatcctcctaactcagcctcctgaatagctgggactataggtggattccaccatgcttggcttacttcctagtgtttaatctttcaattgacagtgctactcatttggacctgtgttagagatgtgtcacgtatgtttgtcagcaccctgcagaaagagtaggggtttcataattcaaagtgattttcagcaatggcctcactcgttttttgctttcagtatattgcaaaatactgtggtttacctgtgcagggagaaggctatagtttatataatcttaactgatagactcttttatatggtttgtaaggagatggagattgaccatgaaaatctttagtgccactctgagatctcactagttatcttgaggaaaatatttaaaaaattgttcaacttagggatgagttacatacagtatttttcttctaaacaaagacaagtgttccaaatttgcttatcttttcttgctaagcagttggcaatacccagaagatattgttttttaaaaagtgaattttaataatgagtgaaaagtaaatgctttaaaaaagcatatcttaaaaatggatgctgaaaaatgtttctatcttctctgtggttttgttgctttgccacctaccataaaaacccctagtacctgcataattttaaaagttggaaataaacatttctaacctctttaaagctttttcaaaggaaagattttggcaaattttgatcccatttgttaaaaatggcaatatatcacgccttctgattagtttgcaggcacagctgattgacatcaggaactaagaaaatttattagacaaattacagcaaacacgtttgaataattgaaggatgaagtaaaaaacacattcaggattacatattaagcatagacaatgatgtacttctttttgaatctatgtatctttatgagctctctttttcaaccaagatatttattaaaacctagcaaataatctgatttagaacaagtccttcaaactgctgtaacgtaagatttaaaaaattaaacaatgttggctgggcgcggtggctcacgctgtaatcccagcactttgggaggcggagacgggcggatcacgaggtcaagagatcgagaccatcctggctaacatggtgaaaccccgtctctactaaaaatacaaaaaaaattagccaggcgtagtggcgggtgcctgtagtcctacctacttgggaggctgaggcaggagaatggcgtgaacccaggaggtggagcttgcagtgagccgagatcgcgccactgcactccagtctgggcgactgagcgagactccgtctcaaaaaaaaaataaaaaaattaaacaatgttgagtcatataactttcatttgataaattatatcaaacaataattttaagtgagaacaaaatcatttttgtaccatttagagtcttaagtattgctgttttaataattcttttaaaattcatatttctgtatatgtttatatcataatgtatgcaataatatagttgtactgtataaataatttgtaaataaataaactcatatttaattttggggtggcatgggctttaaaaacctgattgtgttaaaatttggaggccgctaaactagactactagctgctctagacacttgacagcgaacatagccttgagttatctgctacagttcccaggcaagagcctggctgagagagctgaaatttaggtaagggacatgctaaccatccctcccactgactcaaataggtattatgcattcaatccttggctcaagctagaccattgataggctacatatctagcttaaggataggttaaggtgaaatcgtagagcaggcaaggtgctagaaggagcgtatgggtcaataactggagaaggagaagccaggtgcggtggctcacgcctgtaattccagcactttgggaggccaaggcgggtggattgcctgagctcaagagttcgcaaccagcctgggcaacatggtgaaaccctgtctctactaaaatacaaaaaattagcggggcgtgacggcatgcacctgtagtcccagctactcgggaggctgagggagaactgcttgaatctgggaggcggaggttgcagtgagctgagatcacgccaggcactccaacctgggcgacagagcgagactctgtctcaaaaacaaatcaatcaaacaaacaaaaataaaataactggagaaggagaaatgaatcaaggtatggaaggattgaaattttgtgacactctccatctccagactgacccgcctcaggtcttagaaaggtcatcccgaggtaatactctacagcacatctcattccccttatgaacctgcctctagtcagtcacacaaagcacacaagaccacaaagaagacaaagcgctgaacggtattatcttctcttgttccttaatcgttttacacatgtaaaccctggataatgtggtagtagttaaaagcaagaatatcagacagaccttaatttgaatcctggttccactggttgcttgctggctctgacttcttttgaatcctagtttcttcatccacaaaatgaagatactaatacctacctctcagggtagttgagagaattaaattcataggaagcatttagtaagtaatctggcatatatcaggtactaataatgatggcattattcaccagattgttacctcctgatggttggaaccatgctaggtgctcttttttttttttctatacccacaatgcctaacacagatctaagtatacactaggcgtgctcatttactacttgttgaactgaatagaattagtgggaaagacgtgtcaggacaaagttgatttaggaatctagtgcaatctgacattagagactttcaactaatttactttccttatctctgctgtatgaacttattttattttgtgtcaacttttattttagattcaggaatacatgtgcaggtttgttacatgagtatattgcataatgctgaggtttgtggtatgaatgattgcgtcacccaggaagtgagcatggtacccaataggtagtttttcggcctccgtcccttccctccctctcccctccagtagtccccagtgtctactgtccccatctttatgccatgtatacccaatgtttagcttccgcttataagtgagaacatgaagcatttgattttctgtttctgtgttaatttacttaggataatggcctccagctgcatccatgttgctgcaaaggatatgaattcattcttgtttatggctatgtagtattttgtggtatatatatatatatatatatatatatatatatatatatatatactacattttctttatccaatctaccattgatgggcacctaggttgattccattctttgctattgtgaatagtcctccgatgaacatacgagtgcatgagtttttttggtagaatgatttattttcctttgggtatacacccagtaatgagattgctgggttgaatggtagttctattttatgttctttgagaaatctccaagctgctttccacagtggctgaactaatttacattcccaccaacagtatataagcattcccttttctccacagccttgccaacatctgttaatttttgactttttcttttgagacagggacttgctctgttacccaggatggagtgcactggtgccatcatggcttactgcagcctttacctcccaggctcaagtgatctttccacctcaacctctcaagtagctgagactatgggcgcatgccaccacacctggctaatttttaaaattttctgtagagatggggtttgccatgttgcccaggttgtcttgaactccagggctcaaatgatcctctcaccttggcctcccaaagtgctgggattacaagtgtgagctgtgcctggttgacttttttttttttttttttttttttttttgagacaaggtctcaatctgtcattcaggctggagtgcagtggcacaatcacagttcactgcagccttgacctgcagagctcaagtgatgttcctacctcagccttcagagtagctgggattacaggtatgcatcaccatgtccagctaaatatttgatttttctgtagagactgggttttgctatgttgcacaggctggtcttgaactcctgggctcaagtgatcctcctgtcttggcctcccaaagtgctgagattataggcatgagccaccacgcccagcctttttgactttttagtaacagctattgtgactggtgtgagatgatatctccttgtggttttgatttgcatttctctgataattagtgatgttgagcattttttcatatgtttggtatgtcttcttttgagtagtgtctgtccatgtcctttggccactttttaatggggttgttttttgcctgttgaattgtttaaggttcttatagactctagatattagacctttgtcagatgcatagtttgggaaataacttatttttgaaagccattctgaattttttctaaccccaaatcttattgcaataactcttctcatatatttatacatatttcttccttttagggggaaaataaaaatcatcccattttcatcagtggtatcagttttctcttcatcagtgaagtctgaaatatttgactttatcatctccttcaatcctagtagaagaatgctagcaatatcattttgcttctctctgcataaaactattcataaatggctcctttctatctactagtgagcccaaactctgaacctggcactgaagacctggcatttaaccaggccccatctgacctatccaaatctgtttcctacaaagctttctgttgcagccaggcgggtcttaccactggggtctaagcactatgcacaactcaaactgttttcttttgctaggttaggatatcccatttctaaatgtgaggctttacctagctactaatgccccattgagttcttcaagattgctcactagctatatcactcatttggattctaagctctctgtttcatgtgtaaaagatttgacccacctgagggcagggagagggtcttatttcttatttcccattgtgccatgtattgtgcagagcacatagtaaatgattaagatgaaagaaccatgaaggtgctttttaaacctaaatagccatggattatcgaaattaatctgtgcatataataatcatttactgagtacctactgcgctggataactaggatggatgtaaggactttctaagtgtcctttagggactctcaaaaattcatagggaggagaacttgataaaagactagattttctgcagttaagtgggatgaatgctcagatttggtcattaaagttttgtgtgacctcacacacccatataattacagatatttaggttgttgatgtattaacctaattgaagcaagaatgtgcccatcagaagggacttgttaatatctttattgctcactattatatctcagtgtccagaacacagaatttggcatatagcagtattttaaaggacactgttgaatgaacagtgagacttctggagaattgaatttactctgggtatgctgtcaaagtaaggctcctgggaccataaggctgaaggtcacacaatggaaagttcactgggttgttgctactctgaaagattcttggaaaacacctagccaggctcccaaagagacctcaatctgtccctttctattagaaacttctttaaaagcactttttggcagtaataacaccttttcctcttatctgaaagctaaagtaactttatacaattttcataaataatgaaaacactaaatcttagtttatcttcttttccatatcttgcctacattcactgtgttacattttgtaaatatcactccgagacaacctacattagttagtctgcatctcttacttgtggtatttgacactcaagttttcagttggacaccttcttcacttttagcaacctcatagtaaaccacaccaaactatgagaaaacagttattccatcacctcagaaagaaggtaatatgggagtcatttaaaaataagtgtaaaaaaactcaaaccaattgctgttgctgttattgctacccactatagggagggaaaggtccttaaatgttgagaatcattttcattccactctgcagagccaaatcatctggtctgtgtgctgagtccaaaaaacactgctgcatagtttcctcaaggaacaaaccagggaaagggaatctgaaaaatcacaataggttttcttttttgttgttgttgttgtttttaaacagagtctcactttgttgcccaggctggagtgcagtggcgtgatctcggctcactgcaacctccacctcccaggttcaaacgattctcctgcctcagctgcccaagtagctgggactacaagtaagcgccaccacacctggctaatttttgtatttttagtagagatggggtttcaccatgttggtcaggctggtcttgaactcctgacctgaagtgatccacccttctcgacctcccaaagtgctgggattgcaggcgtgaggccaccacatctggctcacagcaggtttttaggtgaaaagaacttacaggaaagaacctccttgaaaataaaggttatatgtgatgaaagtgctgctttccagccactgcctcatctgttttctctcttacattaaatggcagtactggtcaaatgccatttgcttctctgtttgttcatgacctattttcagcactatttccttcatttcagcctgtaggttgctattcctcagtggaaagcgcgtggaagcaaacataggatggagactgacatcttgtgtgttactggatgctttcactcagccatatcaacattggtcctattgctggctctaggaacaagcattgtagtctgggttctgtctgagttgctcttcacttggctcttggtgtgtttaactcctcattcttcatgcctcagcctatatgtcacttcttcaaagaggtctaccttgaccatcctatctaacgtatccaccccctccccaagctcagtcactgtccatattgaattcctttaatttctttcacagtaacttatctaacttaagtatctgaagtgatctagtttatttacttgtttttcctctcttccctccctagtaggatataaccttgatgtagggattatgtctgcctcattcagctgttgcatatacccaatgcttagcatggtgtctggggcattccaggtgatcaggagctatttgttcaataaatgaatgagtgagaagaacagagtgcaatgcaggactgtcataatttttctttttcatggtgggtgtagccacagaacagagtctgccaagatttgtcatgctcactgacctctccacacatctgctgattcacacaagaacaaatgatataagtgaaagaggagaattgtctctttagtgattctaaagtttgatgtgaaacttgaagggcttgggagtacaggtagcattttcatttctttcatagggtaaaaggaatgacataggcagataatgaaagatacaggaacttggctgggcaaggtgactcacgcctgtaagcccaacactttgggaggccatggtggcctgatcacttgaggccaggagtttgagaccagcctggccaacatggtgaaaccctgtctctacttaaaaaaaaaaaaaaattagccaggtgtggtggtgcacgcctataattatagttacccgggaggctgaagtgggaggatcggaggatcacttgaatctaggaggtggaggttgcagtgagctgagattgagccactgcccttcagccttggtgacatagtgagactctgtctcaaaaaaaaaaaaaaaaaaaagatgcaggaagttaacagtagactacattcataatgttgagcaggatctaattttctcaagtgtgcaataatgggttgctggtaaagaatgaaatataggaccaggccttgtggctcatgcctgtaatcccagcactttgggaggtcgaggtgggcagatcacttgaggccaggagtttgagagcagcctggccaacatggtggaaccctatctctattaaaaataaaaaaattagccaggtatggtgatgggtgcctgtaatcccagctactagggaggctgaggcgggaaaatcacttgaacctgggaggcggaagttgcagtgagtggaggttgcaccactgcactccagcttgggcaacagagcaagactccatctcaaaaaaaaaaaaaaaaaaaaaaaagaaacatatttcgtgaagacaaaaataatctatttgtcaggagattcacaaacctcatcaaaagtgtaaatttctagattgaactaaaccaggtgcctagttaaatttgaattttgaatatcaaacaaacaatgaataattttttttagtataatatgcctcatacaatatttggtgtcctgtcttttatctggcaaccctgtaagagtattttcatccagttctcattactctatatcattcatagggatattataagaactttaccagatgcctggctgacttctagacttatactcctaattaggttggtgcaaaaacaattgtagttttgccattaaaagtgcaaaaaactggaattacttttgcagcaacctaataggaaacaaatttgttggttttataacatctcatgtatactatacattacttaaatgaatggttttatacgacacttagcttgtgactactttgatgcaggccagagtctggcaacatttcccaaaccatattccataaaaccatagggccccataaatggtcaaatgtatttaaatggtcaaatatatttacagaataaactgccctcttagtcgcagtgcacattaggatattaaaggtgctgaaagtcctgcagaaaaggcctgcatatacatacttcccccaaatttgcttctgttttgaggctccatgctctccaactgaattatctccctctgggattctcatcctcacctcatgtgaccagccttaccaaatgctttgactctgtcattgggccaggttctggactggctgactttcacatttccctctaggggcaaggaatacagaaagctaagatttgggccctgaagaaacattatttcatagtcttcctgagggtctcactgcttattctcaggtgtgttagcaagccagaggttccggggcctgcttgcacatgtgcccagcttagaagaaatcccataataggactcgttcattgtattagacatattttgttgtcatggtttttaaagtacagtacaacaatatttgtatggaaaaaaccatgcttatcataggatgtaatttgtgcataattttctagatggagtccagaatacatctttttcaaaggtaaacttaatgacatttgtttcataaataccatcattcttcactgtcagtcctctgtgaacactctagcctctgacattcagtgaagcaataaagaaatcaaacatgcctacctaacctttatgaaaatatttaaaattatgatttaatttttaatctcccatggcagcagtaaaataaatgatataaatctcaacaggactgtctacttcacaataacacttagggtatggcctaaacaggcaagaattcctcttaatcataaactgatgcggcacaggtctgggcaaagggagggtggtagatgttgacatttcgcatttcctggggacccagagggtagagagtggagaggcagttttgaaatgtcctgtactaacagtttgggtataaatacaatgtcctgttcttccttgccactgaatttttctttcttgtgattaaaacaaaacaaataaaaaccaagaaaactcaaaacacacaaaacaaccgccaggccaaaaagaagtgtaaagacaaggaaaagcatgtattttaaacttttaaaaggaaatgaaataatctactcagtctaaaaggatgggatttaaggtttagagtccattgtgaaatctcttacacaattagctaaggtctgcggcacaaagctatggataaatttagggatgccaaattaaatacgatggtttactgagttaaaatgatactaacataatacactgtagatatagtaactagtttctcaatgtttccacagtttaaagagcagacataaaaaaaattctattagattggtgcaaaagcaattgcggttttgccattaaagtgcaaaaaactgcaattactgttgcaccaaccgaataggaaacaaatttgttagttttataacatctcatatatacgatgcattacttaaatgaatggttttatatgacacttagctggtgaatactttgatgcaggccagagcctgacccataaataggtgctcggtacatgtatgtcaaatctatgaatgtcctgtatataattatagctttaagacaatataatcaaatctatgaacagttgttcatctgatcaaatttttctggaatctctggcaactcagctgatttagattatatcgacagggttcatcaaccctgacactattgacattttgggccagatagttctttgctctaggttctagcctttgcattatagagtgtttaacagcatatctggcctctacccaccaagatgctaatagtacatcctaactgtgatgaccaaaagtatctccaggcattgtcaaatgtccctgtgggaaggagaaagtaaaatagcccccagttaaaaatcactgggttataagtgcccatcagtgacagaatggataaagaaaatgtggcacatatataccatggaatactatgcagccataaaaaagaatgagatgtcttttgtgggaacatggatggagctggaggctattatcctcagcaaactaacacaggaacagaaaaccaaataccaatatgttctcacttctaagtgggagctaaatgatgacaacttatgaatacaagaaggaaacaacaagcactggagtctacttgagggtggagggtgagaggagaaagaggagcagaaaagacaactattgggtactgggcttaattcctgagtgatgaaataatctgtacaacaaacccctgtgacatgagtttacctatgtaaccttcccatgtacccctgaacctaaaataaaagttaaaaaataaataaataaaaatcactgggttagaagacagtacaggtttaggccgagagttcccatgagttgactctaatcctctacagattacctggttctgccacacttgttttgacagatggaatccaaagactttcatgactgcaagaggtggagaatcaagaagacaggccaggctaaatgtccatcagtatatgaatggataaacaaagtgtaacacatccataaaattggataatattcatccataaaaaggaatgaagtaatgatacatgctacaatgtggatgaaccttgaaaacatgctaaatgaaagaagccagacatttcatttatgtgaaatatttaaaatagataaatctatcgagatagaaagcagtttgttggttgccaagggctgggagagggggaatgggaatactgcttaatgaatgtagtgtttccttttgatgtgatgggaatgttttggaactacctagagatggtagttgcacaacattgtaaatgttgtgtatgtaacatttgtaaatgttgtgtgcgtaatatccatttacatgtatattacatttatttacaatgtaaatgtaaatgccgctgaattcttcagtttaaaattgttaattttatgttatacgaatttcaacttgataaatttaaataaaggagaggccagacggacacagcagaggcccaacctaaggagaagaaagtgaatcatgggaagtagaattgcctattttttaaagctatgtttcatggagtgctgagggttctgaggagcttcactggggccatggggaaggtggaaaacagatggggccccaggctcccatcctctctcttgctttaatcaaggttagctatccctactgattattggagacttttgaagctgaaagcacaacttccttcacagggttgttctaaaaatccaatgagataatgtatttaaagttgctagcacatagaaattgttcaataaatagcgatgattattagttttaggtctctgcagacaggcatcttcctctcctcttggatcctcaacccccatgcaaagacaggctaatttgagctctttgccagcaatgcctcctctcctttcactgggtaagttagaatctactcttttcatcagatttacatcaaaaccaatcatgcctctgactatggtacataaaataggttcacttttgaggccagctgaaggtcaaaattgatcatgacacccagttttacaatcatatggcacaaattggcacaaggaaatgactagtcaaaagaagtgcagctgggcatggtggctcgcacctgtaatcccagcactttgggaggcggatcacttgagatctggagtttgagaccagcctggtcaatatggtgaaactccatctctactaaaaatacaaaaattagcctggcgtggtggtacacgtctctaatcctagctacttggcaagctgaggcaggagaatcacttgaacccaggaggcggaggctgcagtgagccgagatcgcgccattgcactccagcctgggtgacagagcgagaccctgtctcaaaaaaacaattaaaagaagtgcttcagtgtcccggacatgggagagacatttaaagaggtaagctgttcctcttttagtgagaatttgaaaggaacaaatgaaaaacccaaatagttcagggttaaaacttagcactcccactctgcttctttaaaatacaatcttgataactcatgacatgtttcatagagggaactatgagtatgtgtgagtgtgtaaagggatgtgaagaaatgtgcctgtgtagagagaaacatgagttgaaggggctttgaaatggaatgcatcttgagttatctcaaattccacgctggacttaggtggttctttctgctctctatgaaaaacaaaaccaaaaggctttggaatgcatcttctccattagtattagacccagttattttatataagtatgaaagaagcaaatggggtgctttgttctgggagtgtaattatgtttctccttctgatgttatcttcccagcagattcaagaggcgttaggagaggtgaggtagaatattcagtatacagaataacaagcaaatgtgtacttgatccactgctgcccctcagacttcctctttcttggtctttctctagtagtattgacaggtattggctttatatcagatccagagagagctggagggagctgtgaactgactttaaacatcatctaatgaaaatataatgcctctgttttaggagagctaaaattgaatatagataagcatcttttattgtttgatttgaacattacatttcattagtaaatagtgtaagctttgttattctgaggaagaggtgtcagaggggcctctggcactttctctcacggcaaagcaccggctccttttgaggggaggagggtggttctttgagctggtcaaccttgcgtgctctgcctccctgcagcctgcctgcttcagtctagcagagacttcagctggctgcaaaatgtggccaccagggacatatgctctggtatctataaacagaccagagataaagaagtcaggacctgggcaaggactctcgtattcaagcatacagtaggcattgcgagcacagtagaagcataaacgaagctctgacaaggtttcttgtctcggggagtagagcagaagcctccactttttccaataactttgcagtgtcagatgccttaacagttcagaggcagatcccaggagggagagggccaaaccctgtgactcttctccagttccaggaaaatgaataagaacgattgatttttcagaaagggagccatgtgcaaaagagggctcttgaccccaagaggcagcaaggggagggaggaggaaacagatgtttgagtaacagcaaagggacccgggaggctgtaatgctgtgtcaatgatgtaatgctcaattgaaatgactcccagagatgcgtgggctgtcccttgcccagggagtgaagagtattcccatgcaggtgcaggtacctgagtcccagacagcaagtcacagatgaacttgtgcttgcttcaattttctttgtctgtttggcccagtctgggccttagctcctagatgctgactactctggggataaagactgaaaaagctttgaaatgtgattcaggaagagccaaaaaaccagggccagagaaagagtggtgatagagctgtgacaacatgtttatagctctcccagccttatgctttcttagattgctttccttggactgaagctcccattggataagaccccagagcttttcttatctatgaatttcttctggaaaatcccagctgtgcatagatcctccacaaggtctggactattcttcaaccctgacttcagatgccatggaagaaaagaatacttgtagaaacgctgtcatttccttgctttaaaccttctggtggtctactaacacttgtccccctagcttcatcttgtgcctccagttattattctcttgtctccctggctttctgtcagtttctagaacactccaggctttatcatacagcagggatttggcactagctcctactcctcttattcagttctcagagccttgccaatgcctagtacatacctggaaccaaggaaacactgagtgggagcagacagtagcggggcaactgtgtttattttggcctatagatgtttggtggagaggtcaggtttggtgatggggatgaagataaagggggaggaattctgtaagtaaaaggaacaagtgtagagcagcgtgagaagaagaggggtcgtgggtgacccttgggtttcatctgttatccatggggcagagctgaagcacatggctgggctctagtactgggacttcactgagaggggccactctaacccaaaccaaggaggaaaacaccagggcaaattcatttattgtcataatctaaaaaagccagatagcagcccgtgggattggtagggagaatttcacttatactttcagtcaagaaactgattattgaacaattgtctcttcatggcttatctctatctatgagagggaagttttcccaaattcctttccatccttggctggaattgatgcctctttcatatgctcacagtactaggaacttctctccatcaagtcactgatgtcagtatactacgcttggcaggtgtgagtctgtcttccctattcatctgtgaggtcagtgaggaaaggaaccgtatcactaacaggtgcctggcaagtgctcgggtttgttgttgaatgagtgaatgaaatgttccttgatcatcaatatggctgcctcttgccttaccacgctcactcactcatttgctcattgattaaagaaatattttttgaggaactgttatgtgtcaagccttctgctaggcgttaaggctacaaaggcagaaaaagacccttctctttcctcgcggtgctcactgtccagtggaggagacagacaagctaacaggttattgtaaggcagtgtggtgagtgctaacagaaagtaaaatgttccctgggggcaaagacagttatggcattgaagagtatgccaggcaaaggaaatagcatagacaaaggcctggaggcaaggcagcatggtatctttgaacaattgaaaaaaatgtagtttagctagagtagaaaatacatctgagggttgtagatctgctgccagccagaacttgtggctttggaagttacacattttgggtcagccatcacccgggcaagtgagacaagcactctgaccactaggcccgtagactacatcttcaaagagcccatagagttaatccacctgtcattctgtccaacaacagcaacaacaacaacaacacacacacacacacacacacacacacacacacccctaccttactataaacaaagtgaaaaaacaaatattagtatacagactatattgagaattcctgtaaatcaagaagaaaaaggcaagcaacccaatagaagaataggaaaaaaaaaaaaaaaaggaaatccagagtagtaaacacaaatggccaataaataaaagaaaaaaatgctccccattgctaatcaaggaaatacaaatgaactatgagaggtcattttatacctctcaggctgacaaaaattaaaagtttgacagttccaagtgttggttagagggtggagcaaagagaggtgtcttttattgttgggtaggatgtaaattggctttagacgcttgagagaggagtttgacaatatctagtaaacttggcaacatgtatacaatccagcattaacacttcttggtatatatctagatatattcttgtacatatggacaaggaccattcatttgggcattgtttctaacggcaaaaaaaaaaaaaaaatgaaaacaatctaggtgtccattaataggagtatgaatatacaaaataaggtatattcctataatagacttttatatagtaggtaaaaggaatgatctagatccataggcagcaaaatgccagatgaataaagcaagttgcagtgtatgtacattttaaaacacacccgaactaaactctgtgttgttaatggattcatatgagtgcacttaaagtatagaaggtattttgaaataatgcacacaaaattcacaatggttattgcctttgaggagtgggaaagataatgggtttgagagtgggtccaaggtgatctgactttatctataaggttttctttcttttatatatgaagagtagtatgatgataaatatttaacaaccggtcctccaggaattaaaaaaaaccccactgattcatagcatttgaggatttctgtgctgaaatactcccactatggctgattttaagctaccaaagttttagcaaccagctggcaaaattcctgaaaatttaacacacagttaccaagaacaagtatgagctggcacagcacaacgttgtgtgtgtgcatatgtgtgttgtatgtgtataaaaacttgaagcattgatgacaacattaacaatcttcagttttgtatactggaaacataggtgtttggttatcttagtttctgaagttttatgtatatattagatttcttggaaaaaaggagacagttctataagaataagagtgggtaaaaatatctgacggattaaattataactggacatagtgtaaagcagggctgtcttctggatgcccttctctatatcttccattttcataacttaatactcattgaatatattgaataaacacagtaagtcaagcatcttcctctctgctggttacatgattttatgaacgaagagcagcctttagaaatagctaacttttatgattgaattaaaaaaacactcaaaagaaaaaataccagttaaccgaagagaatggtttaaataattccctggtatctcaatacttttttgacatgctattggaatacgtttcacttcattgatgcgccataaaaacaattgctcgattgtttgtacaatgtattttttaatgagcctcaaagtcttagaacactgatgatacataatcctactttatatacgctattactactttctgttaccacaactgaaagaggcttaactgttattgtggaaggaacggagcagttaaatgtaatcacggattcccctgtttcccattcatctgttatttagtgagtgcctaaaatgcatctagttcctctggctttagaacagtccattgaagcatacacaatgaggaagctattctttccttattgatttcatctttcattttgacttctggagatcaaaatgggaaaacaggaatccagagagaaatgcctcaaaatgcctcctttttcccacttccctcaacctcaaacatttagaaaatattttagaaataatattataatcagaaattaactttataaataaattatatatatatatatatatatatatatattttttttttttttttttgagacagggtctcactctgtcacccaggctggagtgcagtggcgcgatatcagctccctgcaacctctgcctcccaggtccaagcaattttcctgcctcagcctcgcgaatagctgggattacaggcatgcaccaccatgctctgctaattttttgtatttttagtagagatgaggttttgccatgttggccaggctggtattgaaatcctgacctcaagtgattcgcccgcctaggcctcccaaagtgctgagattataggcgtgagccaccacgcctggcaagttttatatatctatattataaatgtatttatattaataaaatattttataagtaaattatatttgtaatgttacaaattatatttctaaaaattagaaaataataaatttatttgtagaataaattagaaatttatattttataaacaaataaccctggaataaattgtatatttatcaaggaaatttctgctttggaattagatataaagaaaattattagttgctatgacaattacattcaataaaaagtcttgttatattaaatatttacataaaatataagtaaaccctgcccacagagaagtgccacacatatgatgtacattgtatgttcttgactgtgtgtaccctacagaatgcttttaattttttttttttttgagatggagtctcactctgtcacccagggtagagtgctatggcacgatctcggctcactgcaatctccaccccctggctcgagagattctcctgcttcagcctcctgagtaactgggactacaggtgtgtgccaccatgactggctaattttttatatttttagtagagacgaggtttcaccatgttggccaggctggtcttgactcctgacctcagacgatccacccgccttggccccccaaagtgctgggattacaggtgtgagcacacttttgagatgattttcccatagaacccgatcattgtaagcaaagatttactcatattcctgactaattgagattccagttctcacttagcacaagacactgaaaatgttctttttcttatctttaatatagcctatgtgttctaatcttcaaattctacagatgagggggaattgttttgcaggcaataatttgagatctgtaccacttatttttcacattttgttttctttattaaaaatgtttctcaggatagaagttacatttgttctttgtaggaaaaaggaaagtacataagaaataaaagggaatttttgctttttaaaggaattttcactttttgcattttacacttctatcctccttgaatttaatactttgagcttctattactttcgtaattaaaaacagtaaagagcctggtgtgattctgtcctgcgcagctgttccccggagcagtagttgtttatctccacccacctcatttctcacctaagtgcacgttaccaccccatggaaggtttgatggacatggacatgagccccctgaggccccagaattatctttttaattgtgaactaaaggccgacaaagatgatcactttaaggtggataatgatgaaaatgagaccagttatctttaagaacggtcagtttagaggctggtgcaaagggtgacttgcacattgttgaagcagagccaatgaatgacgaaggcagtccaattaaagtaacacgggcaactttgaaaatgtctgtacagtaaatggtttccactgggggctttgaaataacaccaccactggtcttatggttgaactgtggttcagggccagtgcatattagtggacagcacttagtagctgtggaggaagatgcagagtcagaagacgaagaggaggaggatgtgaaactcttaagtatatctggaaagtgatctgtccctggaggtggtagcaagtttccacggaaaaaagtaaaacttgctgctggtggtgaagaagaagatgatgataatgaagatgatgatgatgattttgatgatcagaaaactgaagaaaaagcaccagtgaagaaatctgtaacgagatactccagaatggaaaagtctcaaccagaatggaaaatacaaaatacaaaaaagtcaaaccagaatggaaaagactcaaaaccatcaacaccaagatcaaaaggacaagaatccttcaaaaaacagaaaaaatctcctagaacaccaaaaggacctagctctgtagaagacattaaagcaaaagtgcaagcaagtacagaaaaaggtggttctcttcccaaggtggaagccaaattcatcaattatgtgaagaattgcttccagatgactgaccaggaggctattcaagatctctggcagtggtggaagtctcttgaagaaaatagtttaaacaatttattcaacattttctgtcttatttcatttctgtaacagttgatatctggctatcctttttataatgcagagtgagaactttccctaccgtgtttgataaatgttgtccaggttccattgccaagaatgtgttgtccaaaatgcctgtttagtttttaaagatgaaactctgccctttgcttgtttttttgtatggaatgtcatgataggacatagtagtagcagtggtcagacatggaaatggtggggaaacaaaaatacacatgtgaaataaaacttagtattttaataaagtaaaaacaaaaccaaaaatcagtaaaggaggcttggcatggtggctcatgcctgtaatctcagtgctttgggaggctgagacaggaggattgcttgaggccaggaattcaagaccagcctgggcaacatagcaagatctgtctctaaaacaaatagccaggcatggtggcacgtgcctgtagtctcagctagtagggaggttgagacaagagcatcacgtgagcccaggagttcatggctacagtgagctatgattacaccactgcactccagcctgggcaacagagtgagatccctttgctaaacaacaacaacaacaacaagtaaagaaaaacatatatattttaatattctttcactaggtaataaataatgacccaaagatgagttagatttagtaataaaataaagtttaaaaaaattgtttcattgatataaaaacaacaacaaaaataatgcactatcaatacccaggaatttgcatccttaacttttactgtattttccttccaacaatttatgtatacctaacatatatattatataatatattcatggtctttaatcttcactgtgtattaaaatcacaagggaatgttttttaaaaatactagtgctaggatcccatacccagaccattttaatcagaatctctgggtgtgagatccaggtatggttacttttagaagttccccaggtgattttaacgtgcagtttcagttgagtactactgtaatatatctatatattgcatcattttgaatttttgggttgcaaggaacagaatcactaataaaactggttttaaaaataaaagattttttttggttactgttacttgaaaagtctagaggcaatgaaggcttctggcaccacgtgattaggactccagctaagtttctctgaaattctcttcacgggtctccttcaatgtgccagtgtctctggtggttcaaatctagagggaaaaaggaacataggttcctgtgactcatagaagctttgaataaaagtcttaagttttactctgattgaaccaatatgaactaaaaactgtggctagatgactactgtgggctcttgccttgggcttaatgttacccagccatgaactatgacaaggagggaaatctgtatgcttttagagaggggacaaaggaaattggatattggttgggcaatcaatggatgttcactacatatatgtttagccactttgtattatactacatatagtttattatcctgatttaaaaatgtacatattatattttaatacattttgaaaaatggtttttaattagctacataatattgtatcctatgaatgtaatgtcatttaacctttgctttttttttttttttttttgagatggagtttcactcttgtcacccaggctggagtgcagtggcagaatctcagctcactgcaacctctgcctcccaggttcaagtgattctcctgcctcagcctcccaagtagctaggattacaggcacctgccaccaggcctggtgaatttttgtatttttagcatagatggggtttcatcatgttggccaggctgctcttgaactcctgagctcaagtgatacacccaccttggcctcccaaagtgctgggattacaggtgtgagtcaccacgcccggcctcctttgccctttttttgtatatatatttttttctgatggaacaatcaatggccttaaactagttatgaccatatgaccaagtttacctgggaccatgctcattaatgtctgttgtgctggaataattattaataacgccctattaactctcaaaagttttctggtttagaggataaattatatggccatcttactttaaacctaaatatctgtccatttatctgatcatatccttaagatagattcttggaaaaagaatttctggctcaaagaacagaaacattttaaggttttgatacacattgacaacctttttttcccctagaaattatgcccatttaatattccaaccagcagtgcacaagttagaccatctcataaaattctgtcagcactgagtattaccttccttctcttttttaacatttgccaatttgataggaaaaaaggaaggtatgttaataatttgattagtagttccttggttattggtgagcctgaatattatttctggatgcttcgtgaccatttttatatcttagtttatggcttgtttatgtcctttgctcattaagagccctttgtatatgaatactttgtttaccatatttgttgaaaaaattttcttgtttatattttgtttattgtcttttaaaataacattacagactttacctatttttttttttttttgagacagtcatgctctgttgcccaggctggagtgcagtgatgtgatttcggctcactgcaacctctgcctcccagattcaagtgattctcctgcctcagcctcctgagtagttgggattacaggtgcgtgccaccatgcctggctaattttttgtatttttattgcagacagggttttaccttattggtcaggctggtctcaaactcctggcctcaagtgatctgcctgtctcggcttcccaaagtgttaggattaaagactttgcctataaatttatctataaacactttcctttgttatttttttcattgccattatgctggaaaagtcctttatcatcctgagatcggattgatattccaccttacgtttataatctactttaaattttcttctagaatttcagttttcttttttcttttttgtggagataggggtctcactctgtcacccaggctggtgtgcagtggcatgatcataactcactgtacctcgaactcttggcctcaagcaatccttccacctcagcctcccaggtagctgaaagcacaggtgtcagccactatgcctggctaatttttaatttgttttgtagatatgaggtcttactattctgcttaggctggtcttgaactcctgggctcaagcagtcctcctgccttggcctcctaaagttctgggattatagatgtgagcccctggcctagaatttcagttttttgaaattaacttttgaatacatttggaatttattttggcataaactttgaagagatgttctcagtttattttgtctttccaatagttaaataatttttttcaatatcaatttgaatgaaattgccttatagctataacttaagggaataattgacacctttatggttatcagccttgtgcttattatccaggcacttgtatgtctctccattcactcaagtcttttttttctttgtatctttcattttatccatggtattttcttcaaacaggccttgcatacttcttagtgagattatttctagtgatttcatataatatactggtaaggtaaatagactcttccccccattatattttctcacaggtggttgctgttgtataggaaacctgctgattttgtatatttattttgtatacagctacttattagttttcatggattttctgttgattgattctattggtgttttaggaagaccaatttattatttatgtatttatgtatttatttatttatttatttatttatttgagatggagtctcactctttctctcaggctggagtgcagtggtgctatcttggcttgctgcaaactccgcctcctgggttcaagagattctcctgcctcagcctcccgagtagctgggattacaggcatgagcctccatgctgggctggaagacaaatatttaatctgtaagaattataattgtgtatcctttctaatagttatgcttcaaatttttttttttattttactaatagcacttttagaaaagtatacctaatgctaattgtaggggggattcttgttttgttcctgactttaaagggaatgactctactgttttaattttttttttttttctgagacagagtcttgcactgtcacccaggctggagtgcaatggcgcgatctcggctcactgcaacctctgcctcccgggttcaagcaattctcatgcctcagcctcccaaggagctgggattacaggcatgagctaccgtgcccggctttgttttactcttaaataagatgttggcatttgaattcagaaatacatttttatctttattaagaaacatcattctatttcaagttcaagagttttttcatttctttttttcaaaattgaatttaaccaaatgtatttctgccttttatgtttataaacacaatattttcttcctttgctttactgatgtgatgaacaatataaatcggtttcattataatgaaatatccttgtattcctgaaataaaccatatttagttatatagtgttctttttatatgctgttagattcattttacaggcacttttaatgggatttttgtgcctatactcataaataaaaatggtctagtgtttgtgtggaaagatcatggaactgatctattccataacccagggaactctggtgatgggctttcattattaggattggttatttctttatgttccacttacttctcccacttctcatttattaaccactcctttactctttaacctcctgtaatcttacctccattcccggtactgtattgaaaccattcaggtctacatgtccagtgacctttttattgcccagaggatcttttctcagctctcatggtccttgctttctctgtaataattgacactgttgatatctttaaattctctcttctcttggcttctggcactgtgcactctcttttcttgctcttccatctctaaccagtcctgtctcatggtcccctaattctcatcttctttaaaaccccttaaagttgaacatttcttcccccaggtcctgtcttcagcctttgctcttttctttacccactcttagtaattgagttcatttctgtgtcttcgactatgcacatgccacctgggaaatttcctagtagttactattacatgttaggtgatcaagaaatgttacttcaatttgggcttcaactctgtatgtctgggcttgacaactcctaagtctcagttttgaatttccaactgacttgaatgtttttgatgggatatccttctcacacctcaagttcaccatgtgcacatcagaactcaccaactttcctgctctcatttccttcttcccaatttcactatttctattagttgtagcactttgttctgccataactcaatggttctggtgtaagacaatgtctcatggtgggagctgtggagattgacaatacctgctttgttttacagagtggatgtaccagcaagttattgtcatgcaaaaatattgacccaatattgccagatatcaagatttttcaggagaagctggacattaacaaaacatctttaatgtcaattttcaaatgtttacaactaattcagtttttaaaaaattgagtccatcctctagtggatgctgaggttggaaaaaaaagaaagaaaaatgagtctaaaacaaaacctatctatgggctaattttgacctatgggctaccaatttgcaatctccatgccaaagagttttcagaatcataagttgttttttgtttttttgttttgtttttgagacagagtctcactctgtcgcccaagctggagtgaggtggcattggcttactgcaaactctgtctcccgggttcaagcgattctcatgcctcagcctcccaagtagctgggattataggtgcgaccatcacacccggctcatttttgtaattttagtagagatggggtttcagcatgttggccaggctggtcttgaactcctaacctcaggtgatccacttgccttggcctctcaaaattctgggattacgggcgtgaaccactgtgcccggccagaataatagttttaatactttttttcctgtaggtgttttaaataattggctttattttattttgtcatagagcttgcattatttttcctttatatatattattaattgatacataataattgtgcatatttatggggtatatagtgatgttttgatacatataatgtatagtgatcagatcagggtaattggcatcccaccatctcaaacatttattatttctttgtgtggggaacattcaatattctccttcttgctatttttaaatatagaataaattattgttaactgtagtcatcctacaatggtatagactactagaacttatttctcctatctagctataatttgtaatcctttcagagatctctccctttcctcccttctgcctactcttcttggcctctagtatcctttgctctactttttccttctatgagatcaactttttttagtttccccatacaagcaagaatattttctttattagtccgttttcacacggctataaagaacacctgagtctgggtaatttataaagaaaagaggtttaattgactcacagttccacatggctggggagacctcaggaaacttaaatcatggcaggaggcaaaagggaagcaaggcatgtcttacgtggcagcaggcaagagaaaggggaggaactaccaaacacttttaaatcatcagatctcatgagaactcactatcataagaacagcatgggtgaaaccacccccatgatccaatcacttcccaccaggcccctccctcgacatgtggggattacagtttgagatgaaatttgcgtggtgacacagagccgaaccatatcacatgtggtgtttaactttctgttcctagtttatttcacttaatgtcctccagttccatccacattgtgaatgacaggattccattcctttttttttttttttttttgtgatatagggtgttgctcagttacccaggctagagtacagtggctcgatcacaactcactgtggccttgacctcccaagcccaggtgattctcctgcctcagcctcctgagtagctgtgactacaagtgtgcacctccatgcctggctaatttttatattttttgtagagatgtgtttttgccatgttgcccaggttgttcttgaactcctgggctcaagtgatcctcccacctcagcctcccagagtgctgagattacaggtgtgagccactgcacctggccctagggtttcattatcttttatggcttaatagtattccactgtgcatatataccacattttctttatctactcatctgttgttggacatctaggttgatgcaatttcctggctattgtgaataatgctggaataaacatagtgcggatgtctctttaatcagttttattgatatataatttatgtaatataaaatgcatatggtttaaatgtgtaagttaatgaagtctttgtatgtataacaaatgtatatgcctatgtaatcactaccccaatcatgaacagtattttcttgttcctttctggtaaatctttccctacccacagctgctgttccgatttatgctaccatagtttagttttgcctgttacagaacttcatataaatggaaacaaacagcatacactcttctgtatctgccttctttcactcagcataatgtttctgagattcattcatgttatcgtgcatctctgtcattttttaaattgacatatagtatttcattttacaaatatactacaatttgtctacttagtttcttgttgatgggtgttttgggattgtttcctataggaattttaagtaaaagtagagtttaaaaaaataactataaatacgcagttaaaaaacctagacatcaccgagcaaatccagcttttgattttagttagcttttgttcaagagtaagttgcttttctgttctactcactgctgttttctttaccttgggttttttccacatccctgtcaccattatcattcatcatccattgttactgtaaacaatccaccggagttcaccgtaaatagagcaggtgtgaccctagcaacccctccttcatttgaggtactagttcctgatggcagtgctatctggttataacctttataggtctatgtcatgcagatcatatatcctaattaattaattgtgttaggaaaccttactagtaagagaaatgcctgtttgccattcctggatattcatgctagaaaccttgtttgaagtataaacaggaaggaccgtgagtgaatttattaccactcttaggttagctagtcttgagtaattagccaggaaatctttgtgaatataaacctggagatgaaatagaaaatatgccagatattgggatatttgatatatatatatttatgaatttcatattcattcaataagcatttatattttgtttgttatgatttttcaaaaacaaataatgtgaccaggtacagtggctcgcacctgtagcgccagcactttgggaggccaaggcaagaagatagcttgaggtgaggtgttcaagaccaggctgggcaatgtagcaagaccttgtctctaaaaaaacaacaataattaaaaaaaacacacttcagatactgttgaaacaccttccatactatttcataattctatttccttctcccattcttaatgaagaccactgtcctgaatttgatatgtaacattttcatgcatatatatgtgtgtgtgtatatatatatatatacatttttaataaatacatatccatgaatgatttttagtagttttcccttatcaaacattatacaaatggcattatcttgcatttattattttgtagctagctcttttgctcaaccttatgtctgtgaaagttctcatgctgatacatatagttctaattcattttaatgtctctgtagtattcaactgaatgaatgtgccacaatttattcatccattcgcctgttgattgtcacctaggtggttcctaatttggttattacaaacaatgcagcaattatcatttttatgctagtctacttatatacacatggaagagattctctgggtttttacctagaagtggaattgctaggttttgggatatgtgcaccctgcccatcctccctaccagatgttttcacagcttattaacaattatttaacttcagtttctctgagaatttatgagtgccttgtaatagagtttagactaagtcaatataacagagttacaaaatacagtggtccaaacaaaatagagttagttttcccatgtattacagtctagagtccagttcaggtaggtggcttttctacatgaacgcaggttccttgtgtcatatagctctgacattccccaggcaaagttctgcaaactacagtccttaggccaaatcctgcctaccacttgacttttttacagccatgagctaagagtcatctttatatttttaagtggttaaaaaagaaacagaagaatatttcataatgcatgaaaactataaatttcagtgtttaaagttcgattggagcactgccattcctattcatttccatattgtctaggagtgcttttgaattacagcatcagtattgaatagttggggcagaggctatattgcccacaaagcctaaaatatttattatctggtcctttaaagaaataatttgctgacccttaccttaggatgttgtccatgtctacatggttcaagctagataatcaccaaaactttattccagcaatgggatggaggaatgaggagtggaggacagccaatttccttttcaaaagatttaatcctctcttgtctcattggccagaacttagttatccttttcttttattgttctaatttcttcaactttattttccagcttcagtttcattatatgtatataatatggtttggatctgtgtccctgcccaaatctcatgtcgaattgtaatacccaaggttggaggaggggcctgcagggaggtgattggatcatgaggggggacttcccccttgctgttctcatgatagtgagtgagttcccaggagatctggctgtttaaaagtgtgtagcaactccgctttctctctcttcctcctgctctggccatgtaagacacgcctgcttccccttcaccttctgccatgattataagtttcctgaggcctccccagtcatgcttcctgtacagcctgtggaactatgaaccaattaaacctattttctttataaactacccagcctcaggtagtttttatagcagtgcgagaatggactaatacagtacacacacacacacacacacacacacacacacaatttggatatataatatatatattcatttatgctatccagtttttaatttctaagagcccttcatttttcattgtttaaatgttccttttctagaaccctgttttgtttttgcagatgctgtctgttttcttatctctatctatcttgatatttaatgatattttaagtcttccccaaataatctctttcctccaaattgcttttaaaaaatttttattgtaaataaaaacagatgcagaaaataaacaaaacaaacatatatcgctcaatgaaggactgtatgaaaacatccttgtaaccatcacccagatcactaaacagaatttagccagctaccccagaagcccttccatgttctcccttccaattacaacttcctcattcccattctaaggaaccactatcctgatttttggtgtaatcactatcttatgttttaaaaatagtctgattaaatctgcacattttgatatatttttaattaaaatctgttagttcacccttcagatctttctcttctttacaatttagctcttgaactcggagaataatatctgtaatttctcataatctgagttttgctaatttcacatttatgtggagtccaacacatttttctgtcctttgtgtttttgacaaattggcaggtggatccagagactgcatcagactcagatttgatttctttggcaaaattataggtggtgtttggcaagactatgggaggcaaatagtgtctggttgtctatttttttgtgatatgaacagatattaatgcttaatgcctatatttatcaagtcacagaggttgtaaagttgtggtattttaattctataatatttcctactcattagttgaaatagttttatatagaacaattatcctcatctactattgggttaccaacagtacagttcatatgattcaaacatattagatgggtttctatcctttgtaatttttattagtttggctaagctggaattacattttccagaatccccttccctccgtggcaccaggtgagagttggccaaaagagaaatttgtgcaagatttggaagacagaaatgaagtagctatttcactctctgagggtcgttgttacatgcagcgagaactagacatagaggtgcctgctgattccagcttattcttgcttttctccattcagaattcagctcttcttcccaattgccagtaagagtgagtaaacccaggctagtattgcaggttgccagataaaatgcaggacacagagttaaatttgaattttagatacactatatttattagtataagtatggcccatgctctatatacacatatgtgtatatatatatatgttttacatatgtgtggttttacgcatatttcacacttatataatttacatacatattttacacacattgtacatatacacttatagtatgtgtgtacatgcatgcatgtgcaaaatctggctaccctaccctagacccaccactagatgcagagggaaacagctttccagggacttctctatcagcaatcctttccattcccactctggtaactggatacgtctggctgtttagtgactttcctctgatcttccaactctctctggtccttactttcccagcctctttcccaattatgtatgtttgacccttgaataacacatgtctgaaatgtgtgggtccacttatatgtggataattttcggccaaacacagggatgtcaaacacacttatacagagggctgacttttcatgtatgtgggttttacagggctgactgtgaaacttgagtatatatggattttggcatacactggggatcctgaaactaattccatgcatatacccagggatgactgtagttttattactataacaaatatcttcttccatcatactcataatggttcagttttcctggctaaatcctcactaatacaatcctgcaaatacaaccaaggctttcatgccttgtccataaggtagactctaaaatttgaaaaccaagtaaaacagcatatatgtttgcatgattattcaattctgagtcatgtaatgttgggtcaagaaatgccaagacagtcagtgtactaaaattacattacatcctctatggatcctagtgttttttttttgtttgtttgtttttctgagacaatgtgtcactctgttacccaggctggagtgcagatcaaggctcactgcagcctctatctcccaggctcaagtggtctttctatcttagcctcctgagtatctgggaccacaagcatgcatcacaaagccaggctaatttttctattttttgtagagatggggatttgccatgtgatatggtttggctccgtgtccccacccaaatctcatgttaggttgtgatcctcatgttggagaagcagcctggtgggaggtgattggatcatggaggtggacttcccccttgctgttctcatagtgagtgagttctcacaagatctggcagtttaaagatctgtggcacttcccccttggttctctctctcctgccagtcatgtgaagatgtacttgcttccccctttgcccccctccatgattgtatgttttctgaggcctccccaaccatgcctcctttacagcctgtgagtcaatgaaactttttttcttcgtaaattacccagtctcaggtagttctttatagcagcatgggaacggactaatacaccatgttgcccaggctggttttgaattcctgggttccagtgatcctcctacctcagacttccaaagtgctgggattataagagtgagcctctgcacctggcctggatcctagtcttaaggtgaaatggatgttctctatgtgggtgttttatcgtattttcttaaatccatcaatcaaataaaacctgttctatttcagtttgcttgatgtttggatcacgattttcctgcacatttaaaagcttttcctggagtttgcttttatttatttatctcctcatcctttacccctttcttttgtcattagagttttggaaaaaaaaaaagccagatgaagtattggagagtatacaaaatccaatttgttgttacttaaatatctaaagcattgcagccctgttaggatagaaaatattaagaagacagaatcagacaatcaagtggtgaagcaacctggatgtggggttgtagactcaaattagaaggaaaaattatgtagtgtataagttgaattcagtttattgtatttgggctatgagagcacaccactggaaaatctgaacataagggtttctactggcataatgactattagaaaaagcactcaacttttccatccacattgtagaaggtattagaatctcaggtccgagccaaaagctctggtcaataaacatgaaatcctctgtgatagtgatcccaattttgagaaagtattattacttccacagtgggtagctttttaatgttgggaaagtttagaattgtgtatagacatcactaaataagtgaaaatgaaaacaccagtactttcatgttaagttcagaaatggtgtttttgtaatcattgaggcaatttgtacatgtggtgttttaaacatttgtaatgtttaagataatttgacgtataaaagtatctatcagattagttttatgattccaactgagtaattgattttatacttgtgttttcatcttgaaaagaataagaaagctctaagtttctaagcagtattagaatgttcacacagacttaaagattcacccatatttatacatttcatttattgtatttactagaattgtttaagtacttgtttagttgtttagtgcttgctagggtcatttaaagtatttaaaaagaaaattagatatattaaatttacaaatgcagctgaaaatgtttaagataatttagttaagttagaaattggactgactaataagtagaataatatttgtaaatttaaattaaaagttaagggaaaagctagcttttaaatgttctaatttaaacaaattgaaattaaacaaaccaatgtaatcatagtctttgtgtgtgtgtgtgtgtatttgtgtgtgtgtgtgtagaagtcacctttaatcacaccaagaaacttgcattttcagtttcttctaactttatttaactttgtaatatcttgagatttttttccaaatctgtcactatgccatttatcccattgaagtcacattccttttttagattctctgttttcctgttctgatctggtctggttgttcttgaggcctgctgcacagctgtaataccagaacttccctctcttgctttcctaagataaatccactgttttctatatcagatgaccaagactgcaagttgcccttcaatttccattctccccttctaaaatagtaacaaatcccctaatttttagatgagcaaataaagataagtcctggcatttcttgcaggtaggtgtgactatgtaactaagttctggccagtggaatacaagtggaagtgacacttgcaatttccagattgtgtccttcttacctgcttcatcctgttgcctggaacatggatgtatgtgagggtataccagcctggaacatgcatatgagggaaacaatttgggtaagataaaacaacaggatgaaagaagcccagattcctgatactgtggattcctggtcactcattcatgttgtttaattaaacaaaatatttcaaccctttcttttgaaataatttctaacttaaaaaatgctgtaaaatactacaatgaattcttatatatgtgaatgtcttacacaacaaaagcacaattatcaaaattaggaaattaatattgataaaacactctaatttcatcaatggaatttattcagatttcaccaattgaccactaatgtcattttcctggtctagaatacaatccaggaccacatgatgtatttagttgttaagtctactttaatgtgacagttcctcagtgtttcattgcctttcatgacctaacactttaaaagaggacagtccagttattttgtagaatgccactttatttgggtttgtctgatatttcttcaggattaaattcgggttatttatgcattttggatagaaatgatgttgagtcctcagtacatcatattaggaggcacatgatgttactttgtcccattactggtaatgttagttttgattgtgtagttaagttgcccatgtatttttaaagttgtgttaaaaatacagccgaattctaccagatgttctacgaagaacagctggtaccattcctactgaaactattccaaaaaactgaggaggagggactcctccctaacatattctatgaggccagcagcatcctgatgccaaaacctggcagagaccaacaaaaaagaaaactttaggccaatatccttgatgaatatcagtgcaaaaatcctcaacaaaatacaggcaaactgaatccagtagcacattaaaagctcacttaccacaatcaagtaggctttatccctgggatgcaaggttggttcaacatatgaaaatcaataaatgtgattcatcacataaatagaactaaagacaaaaaccacatgattaccttaatagacgcagaaaaggcttttgataaaattcaatatcccttcatgttaaaaactctcaataagctagatattgaaggaatacaccacaaaataataatagctatctatgacaaatccatagccaacatcatactgaatggacaaatgctggaagcattccccttgaaagctggcacaagacaatgtccctctctcactactcttattcaatatagtattggaagtcctggacagagcaatcaggcaagagaaatgaataaagaacatccatatagaaagcgaggaagtcaaaatatcactgttggcaaatgacttgattctgtatctagaattccccatagtctcagcctaaaagctccttgatatgataaacaagttcagcaaacaggatacaaaatcaatgtacagaaatcactagcattcctatacaccaacagaagccaagctgagagccaaatcaggaaggtgatcccattcacaattgccacaaaaagtataaaatacctaggaatacaggtaactagggagctgaaagatctctacaatgagaattacagaacactgctgaaagaaatcagagatgacacaaagaaatggccaaacattccatgctcatggttagaaagaaaaaatatcattaaaatggccatactacccaaagcaatttatcaattcaatgccattcctgtcaaacaaccaatgacattcttcacagaactagaaaaaatcattttcacattcatatggaaccaaaaatgatcccaaatagccaaggtaatcctaagcaaaaataaaaaaaaacaacaacaaaaaaaaaaaacacaaaaaacaaacaaacaaaacgaaaaccaaaacaaaggtggagacatcatgcttcccgacttcaaactattctacagggctacagtaaccaaaacagcatggtactggtacaaaagcgacacgtagaccaatggaatagaacagagagcccagaaataaggctgcacgtttacaaccatctaatctttgacaaagctgacaaaaacaagcaatggggaaaggactccctattcaagaagtcatggcaggataactggccagctatatgcagaagattgaaactggaccccttccttatatcatacacaaaaatcaactcaagatgaattgaagacttaaatgtaaaagccaaaagtgtaaaaactctggaggacaacctaggtaataccattctggacataggaacaggcaaagatttcatgatgaagatgccaaaagcaatcaccacaaaagcaaaaattgacaaataggatctaattaaactaaagtacttctgcacagcaaaagaaactatataaacagagtaaacagataacctacagaatgggagaaagtatttgcaaactatgcaactgacaaaggtctaatatccagcatctataaggaacttaaatttgaaagaaaaaaaaaaacccatgaaaaagtaggcaaaggacatgaacagacatttttcaaaagaagacatgcatgtggctgacaagcatatgaaaaaatgcccaatatcattagaacattaaagtaatgcaaattaaaaccacaatgagatactgtctgacactggtcagaatggctattattaaaaagtcaaaaaataacagatgctactggggttgcagagaaaagggaacaattatatgttattggtgggagtgtaaattagttcagccactctggaatgcagtgtggtgattcctcaaagacctaacagcagaactaccattagacccagcaatctcattactggatatataccgaaaagagcataaattgttctaccataaacacacatgcacgtgtatgttcatcgcagcactattcacaatagcgaagacatggaatcaaccatcagtgccatattggataaagaaactgtggtacatatacaccatggaatactatgcagccatacatatacaccatggaatactatgcagccataaaaaagaataagactatgacctctgcaggaacatggatgaagctggaagccattatccttagcaaactgatgcaggaacaggcaaccaaatactgcatgttctcacttataagtgggagctaaatgatgagaatttatgaacacaaggaaacaatagatactggtgtctacttgagggtggagggtgggaggagggagaggagcagaaaagataactattgggtactgggcttaattcctgggtgatgatgacataatctgtacaacaaacccccattatgagtttatgtatgttacaaaccttcccatgtaaccccatacctaaaataaaagtttaaaaaattgtgttaaaatgcatgcaacataaaatttgtcatttgagtattcaagtcagtgatatttgagtacatttgcagtgtgcagtcatcactttcatttagccccagaacatttttatcacctgaaatggaaacctcatgcccatgaaagcagtcactacccattcctcactttcccaaaccttagccaccactattctgtttctgtctctatgaacttgcttattctgaatatttaatataaatggaagaatacaatatatggccttttgtttctggcttctttctctcagcatattgtttcaaagttcatccatgttgttacatgtatcagtactttattgattttagtagttggattatgttttattgggtggttattgcacatcttgtttgtccattcatcagctaatggatatttgggttgttactttttggctattacaaaaaaattctgctctgaagatttgttacaagtttttgtgtgaacatatgtttttagttctcttgggtgtatacctagaaacggaattgctgggttatatgataattctgtgtccaacgttactgaggaacaaccaaatagtttttcacagtggatgcaccattttctttcccaccagggaatgagtgagggtgctaatttctccatgtccttttccgttttttgattgtagccattctagtgggtgggaagtggtatttcattgtggttttgatttgcatttccctaatgactaatgatgttgagcatctttcctgtatgattggtaatcatatgcctactttcgtttctgattttagtgatttctattttctctcttctttcttagtcagtgtcgctaaaggtttgtccattttgtggatcttttcaaagagcaaacttttggttttattgatttacttcatagttttttatatactatttcatttatatctgccttaaaatttattatttccttgcatctactattgtttatttgagagtgtgtgttgtttaatttctacgttttttgtgttattgatttttaagtttattttattgcactcagaggaggtattttgtatggttttaatattttaacattcattgagacttattttgtagcctaccatatggtttattctggagaatactccacttgcacttgagaagaatatatagtctgctatttttgcatggattattctatataggtttgttaggtctagttggtttatagtgttatcctctatatctttatcgatcttttgtctacttgttctatccatgattggaagggggatattgaaaagtttattattgtacaactatttttttcttccattctgttaatttttgcttcatatattttgggactctgatgttaggtacgtatacattcataattgtcataccttattgataggttgactctttttatcaatatataaagtccctttttgtctcataataatttttgacttaaagactcttttgtctgatatttgtatagctactggagctctcttttggttactatttacatggaatatatttttttgcatggaatatcttttactatcctttcactttcagcctagttatatctttgcatctaaagtaaatctcttacagacagcatatagtttgggccatgtgtttctttccattctcccaacctgtcttttaattgctaagtataatccctttgcatgtagtgtaattactgatgaggaaggacttacttctgtcattttgctatttgttttctatacatcttatatcttatttgttcctcaactccttcactactaccttttttttctttttttttgagacagagtttcgctctgttgcccaggctggagtgcagtggcaccatctctgctaactgtaacctctgcctcctgggttcaagtgattcccctgcctcagcctcctgagtagctgggattacaggcacgtgccgccacgcccggctaattattgcatttttagtagaaacagggttttaccatgtttgtcaggttggtctcgaactcctgatctcaggtgatccgcccgcctcggcctcccaaagtgccaggattacaggggtgagccactgtgcccggcccattactgccttcttgtgtgtttagttgatttttttagtgtaccattttgattactttctcatttctttttctgtatatttctcagttatcttcttagtattcctaacaataacaattaatatgttaaatttataagaaacaagtttgaattaatattaacctggcttcaatagtatataaaaaatgtatatatatatatataatatatatatctgctcccatataggaccatccttccctctttatgcaaatcgtgtcacaaattacatcttatacattgtgtgcacattagcatagatttatagttattgttttatgcatttgtcttttaaatcacataggtaaaaaagaggcattacaaaccaaaaatacaataatattagatctccccagctttattttcatataattgagaaataaatattatatatattgaaggtgtacaacatgcttttttaatatatgtattctatatttacctatgtagtgacatttaccagtattctttatttcttcatagggcttcaagttactgtccagtgtgtgctttcatttcaggctaaagaactcgttttagtatttcttataggacagggatacaagcaatgaacttcctcagcttttgcgtatctgagaatatcttaatttctacttcatttttgaaggatacttttgccaaatacagaattattgattgacaagttatttttttctttcagcagcactttaaatatttcatagtactgcgttctgggctttatggtttctgaagtgaaattggccgttaatctttttgaggatcctttgtgtgtaatgaatcacttcttggtgatttcaagattttctctttgtctttcaacaatttgattattaagtgttttggtgagtttaaatgttttactgagtttatcctactagatataaattgagtttcttggatgtttagattcatatatttcatctaatttggggacttggggccattatttcttcaaactttctttctgttcatttctgttttttaaaattttaatgtatttatttattttgagagtgggttatgagactggctaattattattattattattattattattattattttgttgtagagacagagtttcatcatgttgcacgggctggtctcaaactcctgggctcaagcgattcacctgccttggcctcccaaagtgctggcattacaggcatgagccaccgtgcccagcctgttaatttctttctattttctccttctgagactcctattatgcctaagttgacatactggatgatgtcccacatgtcatttaggctctattcatttttttttcattcttttttccttctgttcctcagactggataatttcagtggcttatcttcaatttctgtcattcattcttttgcctgctcaaatctgctgtcgaatggttctagtgaaatttttgtattagttacttttcttttaggctccagaatttctatcttgttccttttttacaatttcttttattttattggatttattattttattctctatttggtaacatggtgttcttttggtttcctttagttctttgtccatggttttctttagctccatgagcatgtttaacacacttgatttaaagtcttgtctaataagtccattttcctggattccctcaggaacagtttctgttgatctcgtattttcctcataacagaccatgctttcctatttctttgtacactttattttatttttttttaaattagagatggggtcttgctatgttgctatgtgggctggtctcaaattcctggcctcaagtgattctcccattttggcctcccaaagtgctggaattacaggcataagacataagttataattttttgttgaaaactagacattttgaacattattttgtggtaactcaggagattagattctcaccacttctcttgagtttttgttgctgcttgccttatttatgcttatttgtatagtgccttttctaaactaattttgtaaagatgatattctttgttgtgtgtgatcactgaagtatgtggtccattagcttggtggtcagttattattttgacagggtttccttaaatgcttagaccaggagaaagaaaaatctactctcagtgttgacatattagatctgtgttggggcactcattcatagcttagccacattgcttacaagtctacctcagccttcacttcgtgcttgtgcagagcctaatggtcatccagaggtgaaagcttagggtcttctctggctttttctgtacatgtatccatccttggctagtcttatggttttctcaatttctcagtgtatctaggagctttaaaaagccattttacccacatataacccctttcctaatctcttcccatgcttcttggtctatctattgcttgtccccactgttgttccttggcacagtccactgtggccaatacttgtacctttacatatttatgttaaatgctgccttagaagctgtcccagccctgggaatgctctgagtcaaaaaacaaaggcagcccatgtgcctgttcttcagtgggccaccagactgctagaaatggacatccagaattatttgagaaaaagttccatattgctctctctggtactaacaacctttaccaggagtgtgggctgctatccttagagccactgctgatctgggagttgggggatggtaggcaggccattttaaatgctacatctctctcttaccatattgcagccatttctttcttcaccatgccttccctagtgattgtaagtttttgactagatttcagagttctgcaaaagttgattctgacagtttttgacagtttattagttgtttttgttgtggatggagcactggagttcccttgccattttcattgatatcactaccctgtcctttttcctttttttttcttttctttttttttttcttgatggagtcttgctctgttgcccaggctggagtgcagtggcacgatcttggctcactgtaacctccacttcccaggtttaagtgagtctcctgcctcagcttcctgcatagctgggattacaggtgcccgccaccacgcctggctaatttttgtatttttggtagggatggggtttccccatgttggccaggctggtctcaaactccggacctcgcgatccacctgacttggcctcccaaagtgctgggattgcaggtgtgagccaccacacccgggcccatttgttttttttttaagaaaaattactgggtagctggtgtgggttttccatttgctattgcataaagcagctttgttttccaggtacatctctccactgatggctcactgggatatctgacaggaatgtctttatgtagtagggtggggatgggggctggttgcttggaaagttttgttttgggctgggaattggctctctggctattagccttctaaatgcctagtgagaaggatatttctctgagaagcctatattcaaaccaaaagttttagctttattcatagcattaatttcttttcagataaaagccttctagtttttgtttgtttgtttgtttgtttgtttttttgcttgttagcaaatgcgagtaaatggtactctagtaaggaatttgggaggaatatggtggtggggactgatacaactgttctgttttacaaatcttcaattccccagtttaaagccccacttctcattcctgttcccttctgtacttgctgacttacagcccagagtatctccaggattctgccaaataggctggctcctgtttcctctggagcttccttataacattttctaggctgtggttttatctatctgtttcatctgccaacttgctcatatctactttccttcttccagaaacgtgttgggatctctttttgttggtaatttcctcaacttctgtctagttctttttgcctttggaggtttattcccttatgtactgctgtacttttatattaagggaatctaggaggcgttgggagcaatgtatgcagctagtctaccatcttgaactggggtcaacaaatagttttgagtaccttccctgtaccaggtactatgctaggtgctaggggtgtaaacatgaatgaaacttatttcatggtatcaaggagctcatagtgtggtagcatagggagacccatgcaatggatattacaatgggacttgtctccaaagctgaaaacaaagggtattaagggctcacatattctaaagagaggtgacacaccatttttacagaacttgctaaaggacaacttccaaaatatgatttgtgtccattaaatcctttgaaggcatgtaaaggaagctggggattgactgagaggagagtgatagaaaagatagttttgaagagaggtatgggagtgctatggagtttctcctgctcatgggggagtggaggaggtgtttcccactcacttaagtggaaggtggctacaagagaatcactccaggagctttgacatgtgttccctggggattgatatttgtaggagctggtaacttactcgtacctaaaaacaaagtctaaaggtgaaaggggctacggctacggcagcctgtgaaaacagaggaaagagagagggctacattggcagggagctgtacttctgccagtgtgtgggtgaagctgtctgtttcccaggggccagaggtggtcatcaggatagaaagttagagtcgggtcatcttattaggggtctcccctaagaggattgcttagaggtatgcaatgatccaaacagaggaatggactgatggaaacccaggacagaggagttgaaaagggcctgccagatgaagtgttgcctaggccaggaaaactgcaggtgagagatctccagtgatgggaggctccaaggaaccctttagagaaagtgtcagctttggacatatgccacactcttcaatcaatgccaggttaaaatttaaccagtcaaggaaagctcttttttttggcccttactttttctagtccttccctggcagacttctttcaactcctcggtcctgggattccatcagttcattcctctgttgggatcatttcagagttggaacagcatagggagtgtgtgtggtggggtgtgtgaggagggatcagaagaggaaatggaccaatggggaagtcaaccatgctccacatccttcccctactgtgtttcttggctgagttagacctgagcttggggaggagataagcttggaaatgggtgacagattgaagctataatatactagactgaactgaaaactttaatgcctgaaaacaaaactatgttttaatatccgagagtgactgaaaaagatatgagatctgtctgaagttttatgcaggggtggggaaaaatgattccacagagcttgtgatgtgaaagaattatattgctttctgcttacaccctactgtgtctagctcattcaataaactagtttatataagtgctacactatatgtatagtcaaggttcagtgagtaggtagcacatagaagaaagtaataaactctttccagggaggccaggggaaggcctgacactttctctcagaggagttagtgtttgaactgggtcttaaagaataagaaggaatttcttaggtgaggatgaggcaggaggacatttcagaaagagggaacagcatgtacaaaagtaggaggtgtatatgggtgattgcatgtggtttggtgattctgaatcattgtagtgtaaactgctgttgggtggggagggaggtcatacttgcattttaaaaggtcacttttgtcacaatgtgttaagtgggatagtgagaattgtggagactgggaaacaatgtcaggttaacccagacaaggagagctcttggttatctagaaatatcctaataatagaccgatctacatttaagaacatttgaagccaggcaatgtggtgcctgcctgtagttccagctactctggaggctgaggcaggaggactgcttgagcccaggagtttgaagctgcaatgagctatgatagtgccactgcactgcagtctgggtgacagagcaagattccatctcttaaaatttgttttcatctaaatatagtagattcccagcttgagttctacctgggaattggacctgtctgggattattcaatgaaccgcagggatgggcagccatgtcttttagcatcaggtcctgtaaggtccccctaaagtgagctcattctaagccagtggtccttaacctgaggttcacaaatagaatccatggggtctgtgaacttggaagggaaaacaattacatctttgaaacttagtgctttcccctaattatgaacatacacagcaaactacagtggcattagccatatctgtgaccctgtcatggatagaaatcacagacattttcatatcacgttgcatttttttcagatgtctcaaaatagtatttactcaggcattgctttgagttattgcggtgttagacctgctgctggatcatttatttaatgtgttaataaaaagcatacatgttatataaaatttgttctaaaaatagtttgataactattacaatgtaacgggtttcctttgtaatcctatgtattttgttttatgcatttaagaacattagtctgagaaagggtccatggggttcattagagtgccaaagagttgcatggcacaaaaaaatggtaggaacccctgtttaaggaaaaaaagaatcacccaaatttgtctccctgtccacttacacgcaggactgagtagctgatgatgaaaagggatacctgcatgctccctgtgagaaagaggcttctgttaacttatactatccgcccttcctttttttcagtaaaaaaagataatagagcataagcggccttcttccccacttttcagcagagcaccacgcagatctgccatctctaggctcctcagctaaagcaagacatcaaggagcctggtaggagatggcaggagatgcctaatgggggacagtgatgcctggctgatgccataatgtccagctaagagagtgaggaacagaggtggaggcagaagaaagaaatggcagaaaccgcatcgtgggtgataggacagctggttagactagtttgtgcttgcaggtgatatccactccctaagaatgcctggagacactctggagggcttttaattgaagaagccctcgacccacgacaggttgcggggtgtgatgttccccgccctgtgtccaagtgttctctttgtttaattcccacctatgaatgagaacatgcagtgtttggttttctgtccttgtgataatttgctcagaatgatggtttccagcttcatccatgtccctgcaatacaaaaaacagtaaaatttggtgattccatttaatagaaccccttttactatccacaggctagagaaacctgaagaaatttgggttccaaagctatttgttgtgggagtgacagcctgattatactggttttattactttttatataaaaaagcaaaaaaacaagtgagttctccctttcatgttcaatattccattagttgaacatcctctacgtgtgttcatagaaatattttatgtcctgagaataacttcagaggttgagagcatatcttccccagcgtttgctttagagcttacttgaataatcagctccctgctttcagaacaaatcttagttttcatgaacagcagtatcatcagtcattcattgatggatatttgaatggaaaaagtgccaggtgtttcaacttcctctccagcaggtttacaattaagctgttagtagtttgttgttggtttaaaaaaatttttggtttgttttatgcacagaaaaggaattcccataatccatcagatggagatgtgctgctggaaatgctgctaccttgtgaccaaaataaataaataaacaaaaataaaaataaaaataaaaaattgctgggttaccatcagctgtgtccattcagatttatcaatcataaattgaggttccttgcattacaaatgtgggctattcttttttttattattatactttaagttctagggtacatgtgcacaacgtgcaggtttgttacataggtatacatgtgccatgttggtttgctgcacccattaactcgtcatttacattaggtatttctcctaatgctatccctccccctgctccccaacccacgacaggtcccggggtttgatgttccccgccctgtgtccaagtgttctcattctcgttgttcaattcccacctatgagtgagaacatgcggtgtttggttttctgtccttgtgatagtttgctcagaatgatgctttccagctttatccacgtccctgcaaaggacatgaactcatccttttttatggctgcatagtacttcatggtgtatatgtgccacattttcttaatcagtctatcattgatggacatttgggttgattccaagtctttgctatcgtgaatagtgccatgaaaaacatacgtgtgcatgtgtctttatagtagcatgatttataatcctttgggtatatactcagtaatgggatcactgggtcaaatggtatttctagttctagatccttgaggaatcgccacactgtcttccacaaggttgaactagtttacattcccaccaacagtgtaaaagcgttcctatttctccacattctctccagcatctgttgtttgctgactttttaatgctcgccattctagctggcgtgagatggtgtctcattgcggttttgatttgcatttctctgatgaccagtgatgatgagcattttttcatgtgtctgttggctgtataaatgtcttcttttgagaagtgtccgttcatatcctttgcccactttttgatgaggtttttttcttctaaatttgtttaagttctttgtcgattctggatattagccctttgtcagatgtatagattgcaaaaaatttctcccattctgtaggttgcctgttcactctgatggtagtttcttttgccatgcagaagctctttagtttaattagatcccatttgtcaattttggcttttgttgccattgcttttggtgttttagtcatgaagtccttgcccatgaaatgtgggctcttctttaaaataggccatgttattaaatgaaatgatatgcaacacgtacttagaacagtgcttgttgctacacagcaagtgcttgataaatgttagctatcatcatcatcattgtcatcatcatcatccagcccaagaagtgcatatttaaatatacaccctaagctgttgtctttctatatagattatatgtgtgagcagaggggcagtgaattaaagtgataaagaatgtgtcctcacttaggtgtgtgctggctttcttgcaaattcctatggaaaaggagataaactaaagcctcagtttgcttggcaagagcttaatttgtttacgagagcattcgttaaacctttttctgtggaaaattagtcctgcaagatcactaagtgaaaagtgatgccttcctgaataagtttataaagttctccctgtaccccaccttggagggtcatatgtcctagagtacattaagcaagctgagaagtcccccagaaaaaaaggctatttaattttttaaactcaatttgacaaagttccttgactacataactcctttttgttgtaatacttcttaatatccccaggcactggtgttttacatgtagtgggatgtcctatcagagatgattatcttttttcctcttctgagaaaggaattgccagtcactctccatacaggcagagtgacaagggcatcttggaacaggtcttcaagaggtcatcttagttatccagtgttcaccagacagatgtgcatatgcctggagagagggtaggccattcaccatacatccatggaaagaacttccaatccatttgttgagacttggagttaggaggaatgatcaaggtagagagggccattcttttcaaggcccaatgtcaggaaaggacaatagtatccataaaatagtgtgtcaaaaaaacagagtgtggtctgtctggtgggctggctctggtactgagtaaagaggaagaaaggggatggtggtgggattgactatataatttacagtgcccagtgcaaaatgaaaatacagggacccttgtttaaaaattatcaagaatttcagggctgagcgcggtggctcacgtccataatcctagcactttgagaggccaaagcaggtgggtcacctgaagtcagggatttgagaccagcctggccaacatgtcgaaacctcgtctttactaaaaatacaaaaattagctgggtatggtggtgcatgtttgtaatcccagctactcgggaggctgaggcaggagaatcacttgaacccaggaggtggagattgcagtgaaccgaaactgcactactgcactccagcctaggtgacagagtaagactctgtctcaggagaaaaaaagtatttcaggagagcaatagtagagcattaagccaaatatggggcccttccaaacacagtgctctctgtgactgcacaggttgtatactcatgaagccagccctacattgtggtctttggttttctgagtctgtacacaaaagaactgcctggaagtggctctactaggtctatattaagaccttcagaagtaattgattgtgaagtgagattgctggtcactaagagatgtaatgagatgcactgagggacttctggtcctaaaatggcagtatagaggcaacctggcttcactctcccacacagaaaaacaaaaacagatataaaacactgagattttaccagcaacaatccagagctcaggtatgaggacaagacagttcccagggccaccaagtagtggaaaaactctaagtagttggtggtaaaatcagactttcacatctgtgattcctccccaccacccaattctgccaggcaccaagtgtgtggaaaatctccctccaacttatggtttctatgctggaaaaagtgaaattgaggtggtgaactagcttcttcactttcttgggttccctggcaggagacctgtccttgccttaacctaagagacacatcttgactgcctgaagggagaaatatcattgaggacaggcagagcaaggagaggtggggctaccatcttcagccctggaaactctgctctgtagctcaaccaaaggagataccaaatcagagtagctgttcagcagcaccacactgcaggaagtacattctccaggtcccctgggcatgaaccattagccagacttcccatactgctgggataatccctttgggacttccccatttgggacaggcagtgctccaatcatttactagagctgaggtgaacctggggttaaggtgccacctagaactgaaaagaaggcagtggcctagtggcaaagatttgctaagcaaacatattcaaaaggaaaacaaaacaagccagaaaaagaaaactggaataaataaacaatcattcaatgccaagacataaatgtatacccacaaaaaacaatagcaaacagggaatcatgacctccccaagggacaaagcaaaactccaatgactgaccctaataggatggcaatttgtgagctctctgaacaaggattcaaaatagcagttttaaggaaactcatagtgagctccaaggtaacacataaaaacaattcagaaatttagcagagaaatttaacagagattgaaattttaaaaaaatcaaacaaaaatcttggaaatgagaaatgtatttgctgaactgaagaactctttagaggctctagacagcagaacaagccaatcagaggaaataattagtgagctcaaagaaaggctatttgaaagtgcaccatcagaagagaaaaaagaaaagagaatgaaaaggaatgaagactacctataaaatatagagaattatctcaaaacaccaaatctaaaaattattggtgttcaagagaaagcagagcaagaggaaagtgtagaaagcttattcaaataataacagaaaactttccaaaacttgagaaagatataaatatctcggtacaggaaagtcttagaccactaagcagatttaacccaaataagactgccccaaggcagataataatcaaactctcaaaggtcaaggacaaggagaagatcctaaaaacagcaagagaaaagaaataacatataatggagctccaatttttctggcatcatacttctcagtggaaaccatatagacaaggagagagtggaatgacatttttgaagtgctcaaagaaaagaacctgccatccaagaatattgtatccagcaaaattattcaaatatgaagagagataaagtctttcctagaaaaacaaaagctgagagaattcaccaccaacagatccatcttgcaagaaatgctaaaagcacttcttcaatctgaaagaaaaaccactgatgtgcaaaagaaaacatttcaaggtataaaacccactggtaaaattaagtacataggtggcccggcacggtggctcacgcctgtaatcccagcactttgggaggccaaggcaggcagatcaggagttcgagaccagcctgaccaacatggtgaaaccccgtctctactaaaaatacaaaaattagctgggtgtggtggtgtgtgcctgtaatcccagctactcgggaggctgaggcaggagaatcgcttgaacctgggaggtggaggttgcagtgagctgagatcgtgccactacactgcagcctgggtgacagagcgagactctgtcttaaaaataaaaataaaaataaaaaaataaaaaaattacataggcaaacccagaatactctattgctgtatttgtggtgtataattcactcataaccctagtatgaagcccaaaagacaaatgtatcaaaaacaataatagccacagcaacctattaagagataggtaacacaaaaatatgtaagttgagacaactaaaagtcaaaatggggggaaattgagttaaactgcagaatttctttgtatttttttgcctttgtttctattatttgtgatctaagataagttgtcatctctttaaaataatttattatgtttataagatgttttttgtaagcctcttggtaaccacagcacaaacatctgtaatagattcactaaaaataaaatgcaacatattaaaacatactaacagataatcagccacaaaggaagacaggaagaaaggaggaaaggaagagaggagtctcaaaacaaccagaaaacaagcaacaaaatggcagtagtaagtctttccttataataataacactgaatataaattgtcttaattctccaatttaaaaaacgtagagttactgaataaagaagtaagacccaactctatgctgcctttgagaaagccacttcattgataaagaacatatgccgagagtgaaggggtcaaaaaaaatattccatgcaactggaaaccacaaaagagcaggagtagctatacttacatcaaatcaaatcaaagactgtaaaaaaaaaaaaaactacaaagaaggtccctatataatgataaagaggtcaattcagcaagaggatagaacaattataaatatctatgcactcaacactggagctcccaagtatataaagcaaacattgatagatctaaagggagagataggttgtaatataataatagtaggggactttaatatccaactctcagtaatggacagatcagacagaaaatggacaaaaaaatagcagagttaaactacatactagatctagtagcctaactgatatttcacattcttttcatcagcctgtgaaacattctctagaataggccatatcttaggcttcaaaaacaagtatgaacaacttataaaaaataaaagtcatataaaagtcatatatcttttctgaccacaatggattaaaactagaaatcaataacaagaggagccttggaaaatacacaatgcatggaaattaaacaacatactcctgagtgatcaattggtcaaggaggaagtttaaatttaatttttaagaaaagaaatttaaaaatttcttgaaacaaatgaaaatggaaatacgacatacccacatacccaaatcagtgggatatggcaaaagcactgctaaaagggaagtgtatcgcaataagaacctatataaaatagtggaacgacttcaaataaataacctaacaatgcatctcaaggaactagaaaagaagaacaaaaccaaacccaaaattagtggaaagaaagaacgaataaatatcagagcagaaataaatgaaattgaggctaaaaaaataatacagaagatcactgaaatgaaatgttggtttactgaaaagataaacaaaactttagcaagactaagaaaaaaagacccaactgaaattggaaacaaaaaagaagacaaaacaactgagacatcagaaatacaaagaggccaggcccacggtagctcacacctgtaatcccaacattttgggaggccaaggtgggtagattgcttgaagtcaggagtttgagaccagcctggccaacatggcagaatgctgtctctacaaaaaatacaacaaaatcagctgggcatgatggcacacctctgtaatcccagctactcaggaagctgaggcgtgagaattgcttgagcctgggaggcagaggttgcagtgagccaagattgtgccactgcactccagcctgggtgacagagggagactccacctcaaaaaaaaaaaaaaaaaattgaagaaaagggactaactccaagctcattctatgaggtcagcattaccatatcaaaaccagacaagggcacaacaaaaaaagaaaactacaggccaataccactaataaacatagatgcaaaaatcctcaacacaaatactagcaaactgaattcaacaacacattaaaaagatcacttaccataatcaagtgggattcatccagggatgcaaggatggttcaacatatgcaaatcaataaatgtgatcaatgaatgtgatacagagtcgagaataaaaaccatagatgccgagaaagtatttgataaaattaaacatccctttatgataaaaaccctcatcaaaatgggtatagaaggaatgtatctcaaaataataaaggccatatatgacaaacccatagctaacatcatactgaatggtgaaaaatcaaaggccttttctttcgaggactggaacaaaaacaaggatgctcactttcaccattattattgaacataatactggaagttctagccagaacaattagggaagaaaaaaaaaagtgatccaaattggaaaggaagaagtcaaataaccgttgttcacagatgacatgatcttttacctaggaaaacctgaaaactccacaaaaaaaactgttcaaactgataaatgaattcagtaaatttgccggatacaaagtcaacatacaaaaatcagtagcatttctttctttctttctttttcttttttcttttcttttcttttctttttttttctttgagacaagagtctcactctgttgctcaggctggagtacagtggcatgatctgggctcactgcaacctctgtctcccgagttcaagtgattcttgtgtctcagcctcccgagtagctgggactacaggtatgtgccactgtacccagctaatttttgtattttttggtagagatggggtttttccatgttggccaggctggtctcaaactcctggtctcaagtgatccacccgcctcagcctcccaaagtgctgggattacagatgtgagccaccatgcccaacccaaaaatcagtagcatttgatatgccaacagtgaataatctgaaaaagaaatcaagaaagcaatcctatttacaacagctacaaaaatataaaatacctaggaatcaatctgaccaaagaagtgaaagatctatacaaggaactataaagttctgatgaaaaaaaaaatagaagaagacacaaacaaatggaaagctatttcatgctcatggaatagagaattagtattgtttaaatgacaatactacccaaagaaatgtacagattcaatgcaatccctatcaaaacaccaatgacattcctcacagtaatagaaaaaaaaatcctaaaatttatgtgaaaccacaaaagatcgcaaataatcaaagcaatgctgagcaaaaagaaagctggaggcaccatactacctgactttaatgtttactacaaagctacactaaccaaaaccgcatggtactggcataaaaacagacacatagaccaatggaacaaaatggagaaccttgatgtaaacccatacatttacaagcaactcatcttcaacacaggcaccacaaacatacaagggggaaaggacagtcttttcggtaaatagtgctgggaaaactggataactatatgcagaagaataaaactagatccctctcttacatcatacacaaaaataaaatcaaaatggattaaagacctaaatctaagacctgctaaattcaactactagaagaaaacattgggggaaacgctctaggacattggtctgggcaaagattttttgtgtaagacctcaaaagcacgggtgaccaaagcaaaattaggcaattgggattacctcaagctaaaaagctttgcaaagcaaaggaaacaatcaacaaagtgaagagacagaccacagaatgggagaaaatatttgcaagctatccatttgacaagggattaattatcagaatatataaggagctcaactcaataggaaaaaaacgaataatttgatataaaaatgggcaaaagatccgaacaaatatttctcaaaagaaaacatacaaatggccaacaggtatatgaaaaaattctcaacatcaccaatcatcagacaaatacaaatcaaaactacaatgagataccatctcaccctagttaaaatggcttttatgaaaaagacaagcaataacagatgctggcaaggatatggagaaggggaactcttgaacactgttggtgggaatgcaaattagtacagccactatggagaacagtatggaggttcttcaaaaaactgaaaatagaactaccatatgatctagcaattccactactaggtatatatccaaaagaagggaaatcagtatatcaaagatgtctgcactctcatgtttatcgcagcactcttcacaatagccaaaacatggaatcaacctaagtgcccatcaatggatgaatagataaagaaaatgtggtatatatacactatgggatattattcagccataaaaataatgaaatcctgtcatttgctgcaacatggatgcaactggaggccattatgttaagttaaataagccaagcacagaaagacaaataccacatattctcacttatatgtgggagctaaagaaaatggatctcatgaagatagagaatagatttgtggttacaagaggccaggaagggcagggaggggggatgaaggggacaaaaaagaatataagtgtatttattaccactgaactagacacttaaaaatggtaaagatactaaattatatatgtatattttgcttaaataaaaaatgcattgaaatcaatttcttgcagcagcaacccaatgttttaaatttttattgctgctataacaagttatcacaatcttagtggcttaaaacaacataaatttattatcctatatttctgcagttcagaagtttgaaataggtctctggctaaaatgaaggttttggcagggctgactttaggtgagaatccatttccttgcctttcgcagcttctacagaccactttttttcttagctcgaggttcctttcctccatcttgaaagccggtaatgttgcatttctctgtgtctgtactcacatctccccatgactctattattttttcacttttaaggacattgggcccacctggacaatccaagatagcctccctatctgctgattagcaatcttaatttaatctgcagtagtaattttccctttccatgtaacctaacatgttcacaggttccaaggattaagacatctctggggaccattattctgcctaccatactcagagataaccgagacaaactggaccttgactttaaaacagattattggagtataacatataaaatgtgctcaaatcttaactgtacagcttgatgaattttcccatacatatataactatttaatttgtaaatgtacacctgtgtaaccacaactcataccaaggaatgaaatatatccagtacttcaggaggcttttatgtgctcccactcagccactatccatcccccagcggtaactactattctgtcttctatcactgtatcagttacctattagaaagcattccaaaacttggtggcttaaaataacaaccattttttttggcttctaattctgtgggtcagaattataggcttggctcagctgggcaattcatctgctggtctcacctgaggccacttaggtgattgcagtcatttggcagcttgactagggctggatggtctaatatggtgttatgcatatgactatggttggtgctggctatcagctgggcctctctccctccatttgtatgcttaatcctccaagagggtagagtgggctgctttacatgacgatctcagggcagcaagagggcaagagcagaagaatgctcagaagttgtacaatgtcatccctgctgaattctactggtcaagtcacaaggccatttcagattctaggggtagggaataaactcgcttgatggcaggagctgcagaaaagcttgtggttatttaaaaaaatccacctcagttactgctgtggcttgatgggtgcccccaaaagcatgtgttggaaactgaatccccaatgcaacattattaggaggtagggcttaatgggaggtgtttaagtcatgagggcttcaccttcatgaatggattaatgccaattataaaaggggttgaggctgagagtttgacctcttgctctcttttgtcatgtgatgccttctgccatgttatgatgtagcaaaaaggccctcatcagaagctggcaccttgattattgacttcccagcctctggaactgtaaaaaatcaattttcgttctttacaaattacccagtctcacgtattctgttatagcagcccaaaatagactaagataattaccatatgtgtttcctgttcttgaatgtcatataaatggagcatactgaaagtactgttaggtctagcttcttttgctcaacattatgtgagattcaaccatacttttgtatgtgacggtagttctttttttaaattgctgcttgtcatattcaattgtatgactataccactatttatccattctaccattgataaatatttgacttgtttcctgtttgtggctattataaataattctgctattaatattcttgtgcatgtcttttgaagggtatatgtactcagttatcttgggtatgtatctagaaatagaattgctaagtcagagggcaggttaataagcttcagaagatattctcaagtagttttcttaagtggttgtactattgtacagacctgtcagcaatgtatgagagttttgtttgtcccatatccttgctatcacttgatactgtcagccttttaaatttcagccattttgatagatgtttaatggtatctcattgttttcacttgcatttccctggtgactaatgatgttgaacacattttcacatgtttaatggccatttggctatgttttgtgatgtgcttattcaagtggttgtgtgaaatgccagttaaaaaactgagttacttgtctttttcttgatttgtagcagtgttttttctagagtctacatatgagtctgtaattgtatatatgtattacaagtggcttgtcttttccttctcttaattgtgtcttttgctgaaaagaagttcttaatttgaacaaagtccaatttatcaatattttcttctatgataacaactttttgcattctgttttgaaatctttattccagtggaccttgattttaagagttttatagctataactattatgtttaagtctttggtccattttaaatttagtttttttatatggtatgaagtagggggtccaaatttattctctggtatgtggtgtttcagcagcatttgttgaaaaaactgtttttccctattgaattgccttggaacaagacaagtccttttctgtccctttagtgggagtttctatttcaaggacaccaactatctttgtcttggatcatcattgtcctacatatgtgttattttctaattactttaatctcattgacattatttttttgaatttactgtaattatctcaagttttactttatgccataatttgattttcagtaatatctattctggtttcttgttatttttgatctatttaatagatctgttaaggtgcctttttttttcttttttttttcttctgtaatctcccctttctgctttttctgttgttatattatttgtctttgagcccttggtttattaaattaatattcttgttaagttcttttatagcacaacaatcctgtggggaatatacctctattctttgaattatgttatttttatcatctggattctttttccatgatatttgttttcatttttgcagagttaacttggttatgcctaatgtgaaaagcttcacttagctcttctatttgctctgacagagtttaggtacattctccttggcaaccttcccaccttatctgggataattttgtttctccctaggagttagaatttggaaaccgagtgctgctttcaatttgcctttaggccttctggtttctggtaatggtgaataagtttattcagatcaattctcccactgaaaacaacaaaaaattttggatacagtattaatgatggcttctcaaaagcactgaagattgacaatatagtaagaagttaccatgtcaaaaatgaagaaaaggtggtaaagagcaaggaaactcaccattattaacatacaatatagacattaaggtaaaatcattactagaggtaaaattattactatgtttgaaatttttatacaaataaatgttttgatttgccagaaagacataacaattaaaaatttttatgttcctaataacataacttcaaagtataaaagcaaacattgagagtgcaaggagaattaaacaaacccacagtcataatggtagatttcagtatacttccttcagtaattgacaatacaggcaaaaaagattctctctctgaacaacataatgagtacattttttaaaataaatcttttattttggaatagctaaatatagagaaaaattgcaaagtagtacaaggaggtcccatattctcttcaccccgcttcccctgatttgaacatcttaagtaaccacagtatatttgtaaaaactaagaaactaactaatgtacagactttattaaaatttcactagattttctactagtgtctttttttcttttccagtaaccaatccaggatatcacatttcatttggctgtcatgtctccttttcttctctgatctgtcacagtttctcagtctttctttgtttttcatgatcttgccaatttcaaatggtcaggtattttgtagaatgtctcccaatgtgggtttgatgtgatgttttctcatgattagtgtagggttatgagttattggtaagaataccataaaggtgaagtacccatctcatcacatcatccatagaagtgaagtacccatctcatcgcatcatatcagggggtacattatttcaatatgacttctcactggtgatgttaactctgatcacttggttagggtggtgtctgccaggtttctctactgtgaagttactatttttccctttccatactctattctttggaattgtgtcattgatctcagcccatattcaaggaatggacagttacgctccccttactttagggtggagtatctacataatttattttgaattcttttgcataggagatgtgtacatttcccccatctatatatttattctatcatttatttatatcagtataaactcttattttattctttgtgttataatccaatattatagttattaattttgttgctcaaattgtacaatgaacaaatttgacttcataaaaacgatatagattactatgccaaaagcatcagaattaaatagttttcaagcacacataaaacatttatcaaatatgaccacgaactgggccatgacagtcataatgcatttcaaataattgaaatcatgtgtgtgttttccaacttcagtgcattaaaatagatatcaataataaaaactagaaaatccccataattttgacagtaagaaatagatttcaaaataactcttgtatcataatggaaattaggagatattttgaactacgtgacaatggacatattacatattaaaacttgtggtatgcagtaaagtactacctgaagggaaagctacagccttaaatatctatattaaaaagaagaatggttcgaatttaatgaacaaagttcatgacgttaaaaaagaaaaaacccaaagatcatagaaagaagaaaacaaaaaaggtaatgtaaaagacaaaatgcaccagataattaagaagatgacttaaatcaggctattgaaatccagtgaatgtaccttagtgaggaatgtctcaaacaaaaggaagggagcctggaggttttaatagaggcagataaacaaggaaattggaagtaagtcttatgggacatgaggaggatagagatgggtcttttctgcattgcggaagagtgcaggtgggtgttttcttgggttatatgacagcatggtggtcctttacaagttagccagagcacagaagggtgggagtacatggctcacataatgttcaacattgtcagtaagaacaaaaatatacagtagactttggggacttgaggggaagagtggcaggcggggagggataaaagactacaaatatggtgcagtatatactgttagggtaatgggtgcacaaaaatctaacaaatcagcactaaagaatttactcatgtaaccaaataccacctgtaccccaataacatacagaaaaaaagtatatggaaatgcaaaaaaaataataaaaataatatcatttctacttcaataaaaaaaagaacagaaattagctgggcacagtgactcacacctataatcccagtactttgggaggccaaggtgggcagatcacctgaggttaggagtttgagaccagcctggccaatactactaaaaatacaaaaattagctgggtgtggtggcacgcacctgtagtcccagctactcaggaggctgaggcacgagaatagcttgaacccaggagacggaggttgcagtgaaccaagatgacaccactgcactccagcctgggcaacagagtgagaatctgcctcaaaaacaaaacaaaaccaaacaaaaaaaaaaaaacaaaacagaaattaattaaatacaatacaaaataataatgcaacagagtggaccagcaaaagtcattccttctaaatgaaatggagaaatctctaccaagaccgatgaagacaataagaaaatgtctaattaatatcagaaatgaaaaatgtggtatcactacttatgctacagacattgaagagatgagtatattataaatgagtatattggaaaatttagataaagtttaaaaattcctagaaaatattatataacaaaatggactcaagaaaaattaggaaattttacttctattcactgtcacagaccacatctgtataattggaagaaaattactgaaagttgccagacttttgtcgagactcctttcctcagtattaattatgaaagtgaaggtgggtttagaggtatcataaacttttttctcctggttcttttttgtttaaagtttacagcataaggtgttttcctttccttgtctggctgctgttgataaatttgggcagctaaaaaaagtacttttttcttaatttaattagaaatcttaacacagaatacaacaaaatgaaacaattacatgataaaccccaatcttttttttaaagttcagctttttattgaacacattataaaagaggtttagtcaaaaagaccaaagcccatgtcatcatcagactcctcagattcttctttctttgcttccagtttcttctcctcagctggcagtcctttggtaaaagccaggtacatattctatggtagtgcagccacatatattgctttctaatagtctaattaatatatgattaaagaagagaaaaatctggaatagtgtgcatggtgtgtggtcagaatacagctgatacaaactctgagttcacagatcaactgtatctggatcatctggtgagcattttgaggtcctactcttttttttttttctttgagacagagtcttgctcttgttgcccaggttggagtgtaatggcatgatctcggctcactgcaacctctgcctctcgagttcaagcaattcttctgcctcagcctccagaatagctgggattacaggcacccaccaccatgctcagctaattttttgtattttttagtaaagacggagttttaccatgttggtcaggctggtctcgaactcctgacctcaggtgatccacctaccttggcctcccaaagtgctgggattacaggcatgagccacctcacccagccatcccattcttaaagagtctaattcagtagatctgggaccacaccttgaaatctgcattctataagcctattgggtgattgtcatgggcagttggcttgggaaccaagccaagagagagaaccatcttgttttccctctcttaggcatcaattgtcttaactgtgctatcatatttaagatggccctgtttagtaagttccaagaatacagaaattctgtatttgtagtcagattgaaatataatcttgtaagacttttctggagaaaaatttagtaatatataataagattgtagatgcatgcatggggaaattccacttctaagtatatacttacagatgtatactaccagtcatgtacaatgttgttaattgcaactgttgctaatgatgataatactggaaataacataactgcacattcaaagagtgaacagcagttaaaatgaatgaactaacctacagttatcaacataggaagatatggaaaatatcatgtaaagtgaacaatgcaaatttgaaaaagttgatattgtttaccacagaggtaatactacataatgtttatagataaatacatatctataaaaacatacacagcaaggtatatggcttgggttagttttgaggatggaaggcacaagggagggaaggagaaaatatgatacaggaggactttagttgtatcactaacatcaaatttctttaagtaaaaagttctaaagcaagtatgacaaagtgttcacaacactgttaagtccaccacttcctagctgtgtgatcttgggcaaattacttatgcttaacctttatgagccccagtgcctctgtctgtaaaatgggttgataattgtacctttaatacatggagttgttttgaggattaaatgaagtaaaggcattttttgtgtaataaccccatagtaaacactccctaaatcatggctgttatcatgagcaagaaagtgtcaaaagcatacattcagatgtgggtcagtaaaggcagatgggaaaaggtacattcccaagagagatgacatatggcactttagagtagaagcacctctggtgagggtacagggctctgagtgtgcccttgggcagagagcagggctgatttttttttttatttttctcctctattgggtgcagtgtctgtctcctctaagttgtatgtgtgtgtgtcaggggcggggattatatttattatgggagtgagtgatgagtgcctttacctggcacaaggcactgtgtgatctggattcttctaaactcaaatcccaaatttctaaagaatggggtggcaccttcagagagtggtctgctttctagacactgccttgtggaaagcaagataataatggagtgcggattccaggcactggacaaattggtgacaaagtcaccatcctctcttcttagccatgagtgaagtctgaaaggaaaattgatttcttctatcaatggcttttgggcctgtcctccttagattaggaaattttgataaaatcctactggatctcactgtctaatagcaatctgtacctcattgctcaaggctcaagacagtggtggaaaaatgacaatggtagctcaagtggcatttcaaaaagagattgtggggtggtgtggggttgggcttgtcagtactatcctcaccagtgcaaaatagatgctgacttcacctcttctggtttattcaattgtcagatatagcctactggaccttcaggtatctagtgctttcagaagtcaccctcttgccattagatcaaaaccagagtagcagtcattttatactcctagtatcgatgtatttatattaatttttgtaagtggcgctattgataggctatttctaataattgccaagccaaaggggcctgtcagtttcctccaattcaggtccagcgatttttcttaaaggttgtttcccccagcctttctgtaccagtcagtctatgctcatcctggggtaactaactgctcatagatctgcaacctacttggttcttccctttatatttcagcctcctaccttctgccccaaccttaagactctcagatccttggggattcagcatacattctcctttgtttcataccccttcacttggctgatgaatcatctgcccctgcccttccctccaagagtggtgatctaagtctgacttgccagccagttagttggctagagcttaaatgtcccagagttcctgcttccttgagtcctccaggccacattggcatgtaagcagacataagagattgtgtgtatgggtgtgtttgtggtgggggtggaggtgggaggtgtaaatttgtgaatggtttccgtgagaatattcaatagggatgttacttacagatactaaagggctaacaagaagaaagaaaatacaaaaaccgtttgtctatggaaaacaaatttatgtctgcttactctttatggctaattttaccacatacacaataataaccatgagtgttgtcaagatgggtctgatgaaattgattgtaaagtatattcacttacaatgtgccattgtgctcagctgtgctcacacttgcgttgattattgactatgggcttctgcccatgtattctgctcacatggaaaaaaaaaattaaggggatgtgactctagtctttttgagattaactgcctagctgcctcctttcttttcttttggcatctgttgggtagctgtattgaatgggtcactgtgggtacaaagtacaagaaaagaaagtatatgtaataaaaggtgtaaattttcctaaagcggcatgaaaattgttcctcagtactcagcatatatagcttatatttactccatatgccttttctctattctgtttaccacctttgattcctaggagattaaatctgcacaaacgtagatacatactaatactatgaactttaaaatgttattttccttcctttatcatcaatgattatcatttagagttgttatgaaggctttgtgacagaggttatactaaaattgaaagtataagaacttactgaaaatcatgtaaaaattagctatgtttttaatgtggtttctcagattgattaatttatgcaattgaattgttctacctcttgtaaacatacattcacactttgcaaacttgcacacctgcaaagtaaagtgtggtggtatttgtgatattatcattgttttatcaagaatgataactcagccaggttaccctttaaatctcattttataggccattatatatcaccttcctgtctcaatatagtggaaattgattccataaagggctgaaaggccaaaggactttaaagttaataatttaaaaacacattggcatttatgaagtgttgttacattaatttggaaatagtttgaaattgttatgaagtttaacagtatatgaaagcacttccccaaaagatagatacatcagtttggatacagtgaatgcttttctttagggaagtatgtgtctttaaaaaattatttttctctgaattgaaaatatgacaagaatattctcttacagctttcagtctgacttttaaccaagattatagaactcatgaagtagtctctgttttcccctttttctttcctttttcactatcttccattactttgttccctcttcttggcatttataagcaatacatgtaataggaaccatatcaggtgctagaaatccagagatgaaaggccacaatctcggttctcaagggactaagtctagttgaagagaaagaagaataaaaaaactaattacacagtattggtggtgtagtggtcaggaaaaacttcttggaagaggtggtgattgagctggaaggatgagtgataggtgacaaggagataaaattaatcttacttgggatattaatagttttgggatatgatagctctctttataaaaaaaatggcgaagtagagaaattgaggtcctatcccttcataaaagcatctaatggagctggaaaatactgtcagaattaacttttgcggaactctggaatctagtcaaagcgtataacaaccaggggaaagccaaatgaagaaagaagctgctgccttgcagtaagggagttctctggtgtttcaaattgcctgtctccctttccccacacactagattggaggcagccatgaagacagtagcctgtactcctggtacaggatgccatgtgccagatggagcaatacagaccttattctcaaataattgtggttgtgtgttttaatctgtctgatagctccctgaaggacagatgtaagggcttacttctgttttgcccatctgactcagaatttgcagggatggggcagctttccaggtggcatttaccaaaagcatttaaaggcaaaagtattggctgtagcagcctgggacaagggatagcagtcaacacaagcaatagatagaccaaaaatcctgggaagaaagagggtgggaaaaagagatatgtgggagaatgagggcttttaaaacccataatgtaaaccagggaattgagaaagccttgtacatgcccaagactggacatgctcagaaaaggcctgagaagaccctatacttctacttgttgctgactttcaggtttgccacaagcaggaagtaaaggcaaaggaagtaaaggcaaacgcagcattataaatgatctgggtaagcattaaaggagtttcccaaaacagagtcaatatatggtgctgttcctgggttcctgggtgcttgaacccgtctcctgggttcaagcaattctcctgcctcagcctcctgagtagctgggattacaggcactcgctgccacgtccagctaattttggtatttttttttttagtagagacgggtttcaccatgttggccaggatggtctcaatctcctgaccttgtgatctgcccacctcagcctcccaaagtgctgggattacatgcatgagccaatgcacccggccttctttctcttttcttaaaaaaatatttttggggccaggagtggtggctcaagcctgtaatcccagcactttgggaggctgaggcggatggatcacctgaggtcaggagttcgagaccagcctggtcaacatggtgaaaccccatctctactaaaaatacagaaattagccgggcatggtggtgggtgcctgtaatcccagctaatcgggaggctgaggcagaagaactgcttgaatccaggaagcagaggttgaggtgagccgagatccctaacactgcactccagcctgggcaacaagagtgaaactccgtcaaaaaaaaaaaaaaaaaaaaagtaagttacaagccaaaaatacgttaatcttgtcttgtgtatttacctacattgttatctttaccgtgtggtttttgtttgaattctagttactgtctagtgcagcccagaggactccctttagcatttctcctagggaagatccagatcatggacgagcatttagccaaaaggaaaaagagataccctctgagatctgggttgaccagataaagatggaaatgaatttacaggaccttcatggctcaattacttgcttttcttgatgacagggactctaagttcacctgttcaggagctaagggaagggtgcacatagcatgactaactctatggaatgtttgaagtagtaattgagagtacaagagatggaggtgagacaagaacagcacccatatatacacctatccaactccatcacctggctagggattcattccatgatactggatattgtccttcctaagctattggaaacaaaggttctgttgggtcactacagtctgcagcgcaccgattttccctgtggggagcgctgtgccaaatgaagctggtcccagcaagccttgccggtcccagccagccttgcggcacgactcagcttttctctgtgacatgtcgcggagtcgccggtagggttcggtgtggcgagggggacctgcttctctctttgtgagaaccagggagtgagggaggaaggaggccaaggaggaggccaggactgagcaaggactaaagtaagactgaaaggggaggtgaggggtggactggttgtcggcagcagccggtaccggaagtggcggcagcagctgaggcgacgcaccgtgaggcagctgcttgactaggccacagccgccatggcgatgaattttggggaccatgccagcggcttccgccacaatgatgtgatcaggttcattaacaatgaagtcctcatggacggcagcggcccagccttttacgtggccttccgctcgcggccgtggaacgaggtagaggacagccttcaggccattgtggccgactctcaggtgccgcgcgccatcaagagggcctgtacctggagcgctttggctttgagcgtgcgagtggccacgaggcagcgggaggagctgctgcaccacgttcggcggctgcaaaggcatgcggaggagcgccaggcgacctcctgggctctaacgtcccagctgcagcagctgcgcctggagcatgaggtggcggcaacacagctgcacctcgcgcaggctgccctgcagcaggcgctgaatgagcgtgatgggctgtacgggaggctgctccagatcgagaggtttccccaggccgctccactggcccatgaaataatgtctgggccgcaagcagagcagaatggggctgcggcatgtcccctggctacagagcagcagagcgatatggtggccatggggacacatgctaatgcccagatgccaaccccgacagatgttctttatgtgccaggacctctgagtccctgggcccagggcatgcaaccccctctgccagtgccacatccattcccacacccaccaccattcccaatgaaattcccatccttgccacctctaccacctgctgtagtcacgggggcagaagcagcagcagtcccacttcagatgcctcctactgagatccacccaccttgcccgtggcctgcagtgggcttccaggaggagatggcccctctgtggtaccagagaagctacatccaggaggaagattccaaaatccttcaggggtcattccccttaggagacagcagaagccacagccagggagaaggttcagagaggtcccaaagaatgcccctccccggggacagtgggtgccacaacccgctgtcagagagtccccaggggacagccccactggggagcagcggatgccactcccaggaagaaggtacagaaggaccccaggggatggatcccctggggaacagagagagacaaaatcagaaagaaggtccaaagagggcccggaggatgcacaccctggtgtttcgcaggagccacaaatcagaaggtccagaggggccccaggggacggtcccccagggagacagcagaagctacagccaggaaggatgttcagatagggcccaggagatggccaccctggtgtttatcaggaggtgcaaaccagaaggtccaaagaggccccagtggactgtccccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacagaagctatagccaggaaggaagccgagagagggcccaggggatggccaccctggtgtttagcaggagctgcaaaccagaagaaggtccagagaggccccagggcactcccctgggggacagcaggagccatggtgtcagagaaagcccaaagaaatggcaacctcagaggcagaaggccaagaaaccaaaagtgaataaagtctcgggatcccagcagcaggagaagcctgcctcatttccagttccagtgaattggaaatgcccatggtgtaaagccattaatttttcatggcgtacggcctgctataaatgcaagaaagcctgtgtgccatttgagagtggaggacaaactcagtgatttcaggaaggtaagtaagaatggacacacttcaaagagaaagcaatttcctaagaccctcttctgattaaagtataacttatttacttcacagaaaaattgaaccccaaattatggagaaaattaaataaaataatttattatcccattacccaaattagccattttaaaagttgttttggatacacatacatacaaatatatatgcatttatattctcatgttattcatttacttgaacagagatggactacttttgatttctcctgattgcatttaaattttgcaggtggtggattctggatggccgatgctgattggttaataccctggagaagctgaagtcatgaagccttttcttttcctttttgtttcactccttttcctgaaaaagccatgtatgtggctgggagcagttgtgtgattttagagttagaagatatgttgaattttaggaacagtacttttccttgaaaatgctgttattcctttggaaacaaattttagaatcaccacacttccttgaaaatgctattattccttttgaaactactgcaatcttcatgttttcttcattttgctttgttggttttataggtgaggttctgtttttgtatctcagccccaccaaacttgcttgttgctgaagaagctgaacctgttccattagaagatcttccaaagccaaaagaaagtgagactgactgcagacttactggctgcagcagagaggagtaagaggaagtcagagaagaagagatgatttgacactcattgggggaaaaggaagagcagaattgttttgttagaattgaatttttccactgggacaaggaattaacttggaagagtttggggggttgtgttcaattctgtagatggtagcaactttgatgaatttcgtttagtttgttaaatagttattgtctaatatgtgttaggagctagacttataggttattatttggtgcacacatcataatccttgttgctgagttggttagaagataggagagagcataatttgggatacaaattagatcaggggtatcttctttgccttgcatgtagtgttgccttaggtaaaaccaatttaaataacatctagatccatttttgcagttttgtgggcaatgtgaaagagacttgcatgaaaggtcttgagtaaccaaactgctagtctcattggtttgcaggtgagacaaataagcagtggcaaagttcaggaaagtggtcttacagaagtgcaggcagggcttttctgattgtctgctgatttcctcctttgagagggacagatattttcctggctgccagtaagcctgcctgaaagaccactggggtgtcttgaagaaagacagtgctctgaggagtattcactacacactccagccctcagcctcgggctgcccccattccaagtccctttctagtcaataggtggatgaagaacaaaatggatttcaaggacagacagacagacataagggctgtgggctatggatggtgtttctcttgagaggactaattgggttaaaaataaaactggacaggggcgagcactcttgggaatgcccctggacccttcctctttggcgtgttctctgcaggctcccccaaggcagctgctgcaaggcaaggagggatccagggtagagctcagggatggtgggttagatctgcctccagtccaagctaaagatgtcttcaagtttccctgtaagatcccgcccagctcaccaaaatcaacctttgtcaggggttttctgatcctaactagtaataaagagtgtgcactggactgctgtgtcttctgtgtagtgtgtatctcagggcaaattttctcagaggtggaagcttaaatcttcatctttccttcatcccactgaagttcaatctcatttactaccggaggggccttcctcttatgaggaattacccaagaattgggggcacttctgtaggaccttcaatccatcatgattgtcctttctatcctcacagtccaagtccacatggtcccgtgaaggttagcatatcttctgctccagggtggtggggcaggaggggtgagttggggagggtgcttctacctaggcttggagctctgatgcctggaagccagccttctgtgtaccaagaagccatttccctgagatcctgtctccctgaggtcccctaatgtcccatgaacagaaactttcctcctgcatttctgccttccaagtcactgtcccctctcccctatgcataatcctatcaagttgtttaggattctggaaaacagccaggctgtagcctgtctgctcacaagacaaatgttccctgaggtgaaggggagtggaggctggctacctgcttggtatgggcacaggaatggggacagagaacaaaagtgaccttgccccgccagcattctcacttccctcagagtcatgattactgggaggtccttggttactttggaggggagcacttcagaggaagggatccattagggatgtcagacccaaagctaggttttctggattgggggctggttttatgatactcatgtgggctgatagctccttggaattttgggaagatgggatacagatgagacttggacatgtttcagcataatccattttcgtataccagcaggtcattctagatttcactatagttgtttcttttatggcttcaaaatggactctgttgttaattggcatgcttttaggcctttataaaaacagactcaccctgtgtatagcttttatatattttaatatgattacacagtctttcaggggcaacctttttcaaaacaatatgaatcattgaggctgtcagatcactactctcttccaggctgcatacatgcaagaaaaggcagcaggtttctgtggcataaacctgggctttggagacagagaaaacgagttcaactacttgatctattattcagtagctgtgtgaccccaaagaatttactgaatgtctctgagccccacaagtattagttccctttctctatcttcagggttctgctctggatcctgtggtcatgagtgtatgagattattaatcatagtaagagctaccattagagtgcttactatgtgttaggtactctaaggacattgtcccttttgatgactgtaaggtattataggtacccatattaatagttttcaaagtgggtactattgcccccaatttacaggtgtggtaatacccaaatttgggacttagtgaagcctggcttcaaaatgaaattttactagttccaatgtctgtactctccatcatatcacaccacctaaggttttacccttactgagggatacatgtgcattttaacagggatcataatacctaaacccaaagaaatgactgtgatggagggaatttgaggtatagtggcagtctggtggttgtggagctgctcttttagaatatctcaaattttgcctgggtgtggtagctcaagcctataatcccagcactttgggaggccaaggtgggcagatcacctgaggtcaggagttcgagaccagcctgaccaatatggtgaaaccccgtctctactaaaaatagaaaaattagccgggtgtagtggcatgtgcctttagtcccagctactcaggaggctgagagaggagaattgctggaacccgggagctggaggttgcagtgagctgagatcatgctaccgcactctggcctgggtaacagagcaagactcagtctcataaaaaaaaaaaattccaaattttgggatatgtgatcgataacccaggctgccactgagtagggccatttattgtcttagtcaccaagactgcaaaataagggcaatgatttaggcagtgggcatgacttgtgctgattcagcagactggacttacgaaaagtttatatctgagtttagtattaagataggacacatcttgactgcttacctaaagtctgtctgaattattcagtttttgttttaagtgaataaggtggcagctgtataagtccaatatacagtatatatatatatatatttttttttttttccagtgaggaaggaggggaaaattagattttgaaaacttcaggctcatgttgccaaacggggatgttttttacattatggtgctaaatctacaacagaatggcaaagaaacacataacttccttatcacatgctttgtaaagactcaacacggaatggtagcggctgcttcttatgtggtacaggtgctgcacaacactcttcagtggtttcttcacttctagcatgtgatagagtcagtgcatccactggcactaaaactcacatacacttaatgatactcaacagccctagcctgtgaccttatgaggttgctgttgaacagatttttctcattctctatactgtttattctttggtgtttaagaaaagggttcagaaatagtgaaatagacatagtaagtgttgctgcactgggtattaataatcccaggagacctagcacaattttttgagcacaactccctatttggttcactgttggaggcactctcttcaatggacttaagaattactctactaggtcagatcctggtccgtctaggctaacttctctggggcataaagcaattgtggaaaagcaccatatcatcctgagtgataattttaaaggtaagcaatgccactagaaatctctagcttattttattactttacacatcaagtaaacagcattcattcaaggcaggattgttataagctgggcaatatgcttcactctgtggaagtgatcgttattaccctcagtgaccttgtattctattagaagaaataaggtaaatatgcaccaaacagttcgcagtcttttcatcaattgttccatcatatttttttgcttgtagatgccagcttttaaaatattctgtatgcatgtcaaatgacatcaattaataaaagattgcttgttcatttaaaattaaggaaacctatataactataaagttctctcatacaaattcttaccaaatataattctaacctaaaagcagccacttgccatttttcatttaggattttggtgaggattcaatgaattccattattattattattactattattattattattattacatgcagcctaatcccagcaaatggaccattttactaggctctttgtaaaattgacaatacctcaaaatcaatattaccttcttaaaattctatgaaccttgggaacacaatttcaggaacaacctctgtagaaagctagtagttttaatacatgttaaatgccagtgagtgctaaaggattttagagaagtgcagtatataccattttgggttccaaagcttccatgatagccagatggttccgaattgtgtctgcagtctacaaaaaggttgctaggaaaattggctttgttttacttcaaaataatatgtggtattacagcttcacttgagacattttccagcactttgttgcttgtgtctatatctgctattttagattttactctttattctgcactacattataaaaataatttaacacaaggcagaaacctacgattacttttgtggtaggcagcattaaaccataccccagtgtttataaaatgatgacaatgagctatctgaggattttgtctgtaagtaaaagttacaggagatttaatctcatttattttttgcttgatatatatgtttattttgatagtttcagtgaaccatgttggttctaggaaggaaaaagattggacaagtattgaaaatttcatacctttaccactacaattcctgatatcgtctagacagttttgtaacttcagaacatttatgacttgctttgtaaaaggctcatagtatttaactcctcgctgatcaatgattctagcatttttttcatgaaatatttattactgagaaggaaaagcaaaataatgtcaatgttgcatatgtaactacaaaatgcatttagaaattcaccactagctgttttgtttgctgggttataatatttcatttgcatttataaaactgcttagggaaatgtttatagttcgcttcattccattccttcgcgaaattttggtatttgtgatgtatacatcaaagtggtcatctgtgtttgaaaacatcagagatttctttaaaaatgttcaggcaaaaatatatagacaaaataagagtctcttggactttaatcttttcgattaaagctccagtggtggaattttattcttgagctttcaagaaagagaacagattttttagatgaaaagccgcagactcatttacaaagacgtaatattttcttgtgctgatagcataccctgagggcccccacccaggataaagagaggcggaaagaagattctgtcgcgatccaaaggcaactggttgatgaggccaaataagtacatgatgatttatttgtgtgtcaggtgccaaggtgtgggatgtgaagagttatatctataaaccaaaatgaggcagaccacagggtagacgttggtaagtgatgaatgtgaaagaagtcaatgtcagaaatgatatacttcttgaggcaaattagaagccacattctctgcagagggttctctctataaagggaaaaaagagggggaaaggaagggagctaactaggtgccaggtactcttttaggttctgggtgtgctaagaggaatatgacatcatctctgtcttccgggagttcacaggctagtaggagaaaataatattgtgtatttgttaggctccaggcacaccgcatataccatcacatctatcttcatggaaaaagataaaaactaatgaggagtggccttcatttggtctagaaaacattcaaaaaggagaatggggtgataagaccttatctgtgtatccaggtcttcccaggagagaaaatatccgtatcactttaaaaacaaaacaaaacaaaccaaccaaacccaaactactcagtgttctgttactttggatggatgagcttatgatcctgtttccagacccataaacccaggaaacaaaacttgactgtgaactgaagacccttccaagacatagtaaataaagagaatgaggctaaaatagtatatctgatttgataagacatatagttatatatagacatgctatgagtcagggcatgggaccagttgacacttgaaatgtaagaagaatattctagaagtccagattacagtcgctagataggagactgaagcctgagcaatccagtgcagtgacctcagaattaatgttgggaggcagaagaggatagtggtgaagtgcacaggctctgcagtcagtggcctgtgttcatatcctgggcctgacattgaccagttgtgccaccttgaataggctacctaggttctctgggtttcagtttctttgtcggtaaaatgagactaataatagtatttgcttcacagggttgttgatataaataaatgagataatacattcaaagtgcttagcaggatgcctggaatatagtatgcagttaacaaatattagctgttgctattattccgagaatgaaacctcagaagcatgcagagtttcagctagaatgagggaacttcctttgagtcacgaaggaggcaaaattcgtgcaataaaaaaaaaaaaacctgtacacagcagacagaaagataaaaacactttccatctcgaatagattgtgcgagttagaatataagttgagttagatatgccactactatgtccctagagccccatcctttcctctatctcagctcttgttaagtgaattataattgtctgtttgcttgtctgtcttcttcactggacctatgagctacttaggggcagatactgtacttttctgtaacctaagtacctactataatgtctggcatatggtagatgctcataagtgttggttgaaataataaaaatatttaagacaggcttaaataaacacacacaacaaccctgtctctggcttctcacttaaaaagggcatttagaaagattggcctcataggtaaacccagagattatcaaaaggaggtgctcttttgtaaaaaaaacaatttttttctttaatcatttttgtaaaggaagtgaattttagtaagtgctgagagaatgtgtaaactcaccacaggtaacactgtcataacactgtcacaggagaattcacacctataaatgagctagtggaagaacaaagttagttttgaaaggtcagagaaaaagattttgaaatgtcagagccactctataaaactgaccacccttggcatcattcttttaatctacctgggtttgagaatagcctagggcatttgaaatgaagacaattagcacctcagacagggcttccacatgcaaaattctgtcacctctcagagacctcaggagttgacaagtttggttaagaagatactttcaaccttggctggcagtttttctaaaatttcaatgcttttataatctgatttaaatggcatctatattctaaaaggttgtaactgtgaagctctcttcctccattctatgattttcccccttaagttattgtaaaatgtcaagaatgaaaatatttcctttattgagggagattgaggaaacaggtctttgttcttgtgcacaaataagttcaattcatttcccctctgtttctctctaaaacacatttggcttttgtttagagaatagaatgttaaacctagacgtgaccttaggggtcatctggttcaattccatttgacagatggagaaaatgagactcagagagaagtgatttagtggcaaaacatggcatatatttcaactctcctacttactggactactgctccttccaattcatcttgtcatttcaaagacgaccataggcatgtagaaccaatattgtgtgtgtgtgtgtgtgtgtgtgcgtgagtgtaaaagagaatttcagtattttttcttttattgagagcattaagttcattcattcattcattcacacaacaaatatatatagcacctactacttgccagacacaggatacagtggtgagcaaagtacacaaaatccctccatcatggaccttacattctagtgggggacacagacgataaaccattaattaaataattctgctcctaagtggtttatacttgtacttggggtccattcttcctaactctttctctgttggtgcctctactatctccattgctctcctctttcattttctcccatttcctctcgtgtgtatggggagagaaggaagagagtcatttcaattcctcttttctctacgcttcaagctcagtgtgaagttttgaatttgctaaagtcaggtttagtactggtgtaggattagagtgaagatgtcagtatttttcatcaacactgcactagtgggctggctcggctggctcagctgtcagcttgcttgtaagatgacaatgaggtactggatgtgaaagttgtactattaccttataatttatctgttttttagtgcaattttagttgtgctgaaccccgtcatacctggctgctttgacaggtgtgctattttagcaacatggaacaaaacagagaaagaaaaaaagagtgcatggtacgcttgtgctgtcagatccaggttgctctgttcctaagtttatggatgatttgttcagagttgttaagagacaaaaaaaggttaggttttgttttcacttatgtgacactgaatgttctcacagttcacctcacaggtcagctgttgctcatatggactgatataaagggatccctttccctgtctcctttctatttgaaattccaccattttgattaattcctctgggctaaccatttgcctgctcaatatatggagagcccaaggtggacaacctttcaaatccttaatgttggagtatgcattcatatatcagattaatttcttccttgatccaaagcatgaaaaggggtaagaggtggagttggtcaaaaacatgtgaggaaggaagatgataaaataatattggtcccattccccagagccatccccaaatgtcaccttgaatgctttaaaaaaaaattcttaatgctgaaaatgactagtaggagacttatgtttatactttgcatactaaggctggacactcttcaatcaagaagaaaagttgctaccagctaccactgaaatcttagaggattgttcttaatcctagtagatgaagagcaaatatctgcctttggtgcaagtcagctctgtacatccaatccattggtaagacatgtgaggaattaagtgtcgttctcgctattgagttcccagccttgccatattctcaaagaactacacactgaagttgcagaaagcatataatagacgacatagcttcagttatttaaattcaaattttaaaagtactttacataatctaaaggtacatgtacaagaccattcagcttcagcaataaataaagtcttactctagtgaaaatgcaggaagctttgcggaaatattacctagcacattttgaaatagaagcaatgttttatttcagagaagaaaatgaaggttgaaaggttttaaaatattaaagacagtttagcctcaatcgaagaaataacattttctagaaacaacagagaataaaagttacaacaaaattatcaacaacttgcaaatgattcaaaacagattttatggacaaaatgctgaaaggtgggccctgtacaccaaagggcacatacaaatccacataaaggcaaagcaccagttaaatgattcacagtctcatctaaagcccatcaaatagatacatctggaacatctttggatgtacattgtgacttttgtatctcaactagcactttgggaccttggacaaggtgttaggaaagaaatcaatatttgctcaggatcaagacttctcaagatgactgcgtgaggtagaaggaagagggagaagaagaacttgcccagagttcactgttcatctactatgtctgattctgtaggagtcttcatggccatgttcagtaatgattgcatactgacagtactgataaaactatcagtgttttgttctcagagctcttggtcctttcattttgtcagtgtgtttttgccctacgtagtgggtccacataccaacagagacatgtacaacttgcctctatcatcaactccttatgggctagttgagctaagttattcctggtggcctctgagtaaaccgcaagaacagaagcattactaagcatccccgtctgagtgcaagggtgtgtgttggcagtacagccccaatcttgcaaaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtgagtatgatacggtggacatgggcctgctgagggtgtgggcggtgggcaacagcagctggggccagggtggaggccgaggcaggcaggggcgccggcgttagcagctcgccgacgcctcctccgtggcccaccctcaagtccagcccagggccgtggtggaacacactttcgcctcaatccctcgctggggatttcattccctgggcctcctgctctccagaaggccctcaccagagccttttggggcagctgcagagaatgccatttcgggtggtgaaatgtggtccacagtttaccttcgctccgggaaagacccaggctccccacttccattttgacccctatcgggtggcgccctgcgagccttactctagctctctttaaacgacttttgaagtgtcatcccaaaggaagagcatgacattcagagagaggaggcacattaagaaacagagtcaattactttaagaatgcaatgccagttaggtcgagatgctgagagaggagggggatgtgtgtcagtaaaatcacctctctggatctgctgatgtagcatcctttagaaaagtagtggggggtggggaggggcaggggatttcagaaataggacccttcttgataaacgttaggactcacaatagtcttaaagggaatggagggaaaacacccttgttatgattcagctttgccatttgcctaggcatgtctcattctaaggcttcattttgaatcaaattcatctgcgtctttgctccagggctccggagtcaggcagatctgagactttgtcctgtgctcgtcagatgttaggtttgtgacttgggcaaattaacctctcagttccccagttttcttatccattgaataggtatcatattactgcctacctcataggattgtaagattaagtgccataatgcagtaaaaaaattagcactggggcctgacacctagtaaatgttcaataaatgtaagctattggtattattattataccaaagatatattattattttatcttctcttttcagttgatttcttttaggaatcatgggggcatttctaaggaaggacctagctcaggcattattgtcagcaggataaaaaaaaaaatccatgaaaacagcagccctgcattgtaggttctagacagaaaccaaatgaggttaaatgcttggtagtaagttcagcatctgataataccccacaagagtttgaaataccttatgggtcagtgaagaaagattatcctgatgctggtgctagaagatttttcactgtatattgttttttaaaaacggtcaagccttgtttgtggcagctctcaggtcatgctaaatacatttttcacaaaggcttcaagggaaatacgtggaagctattgaatgtcttgggcttgaatctttatgttttgcttatataattattgttcccgtgtggaacctagggaagggcaatgaaaaccagctaggattcttaggctcttttctcattgaaagaaggtggagtgagtgggtgggtgaaaggcgctgctttagggaagctgacaaaggagataacatgctccttaacccaaaggtgaaaaagaatgtacaaaacaagtctgggcaggggagggacaacagggtatagtgagaggcaagatatacctaaggcttcagcctcacggggctcctggccgtttctcaagctcctcaaaaatgcccccacttaggatttctgcgcttattgttccttctgcccaaaataccttcagttcacatgtttgttcaactgtctcctccctcagagaggacttgcttgaccacctatctagaacaagtgccctctccctgtccctgatacactcactccatctctttatttttcttcaaagagctttaaactatctgataatttgcttgtttacctacttattgctgggctgtcctgcaaaaatataatctccatgagggcggagatactgtctccatcaccagaaacacaggaacacataataggcactcagcagatatttttgaattaacaaactgtcaaggcaaattctgttctttactgcaataaacggaatggccattgagaggttagggtatggactctgggaaagtcactcaaattctctgggactcagtttccatatttataaaacaggaatagtaatgtgtatcctaccttctgcaaaagattgccttaagtaccttatgcaagagagaagggcagctttagacttttgcctatgtaggccggaaccacatgaggaattaacttaggcaggtgagaaattatcaagcatttaagttttcgcccaaagtgaatcttgcataaatgcagtttttatgactcttagttctccatgaaaacctccttgtgaagtagcggaaaatactagacaaattgggagttcccttacggtgtctttcaaatggtacactggggcctcaaagtcttatgtgactgttagggtgatagccagaatgtgctgcagagggaagatatgaggatacattgccttttatcagtttctcaatgtttttgagttgagtgtcccttttgataaatgtaaaaatttcattccctctttttggtgctacactgtaattataaaatcagattttatttagaaataaaccacgtactcattttaaaccagaacacttatgatatgcagtcgaaataacaatataagtggtatcatatacacatggacaacaaggtatagctgacaaacatgcattgattgtagggtttactcagaatggtttctcattctatcttttgtttactcctattaaccaagaagatttaattgagctatagtttttatatttttattgtagagataatacatttcatatgccttcaaactgtactttaaactgtactttcaaacgatgcttgcccttttccccagttctgaacctcctaatcatggctttcagatatggccttttcttctgttctgatttagaaaatcgaaaattgaactgcttcataaagcactaaaggagttttccatttataggattgctcaccttcattttaagtaataagtatttctttcaattactttctctaaataaatatagatttttgtataagtctattaaaaatagttccttatacctattcattatagaaaatttgaaacatatagataatagaaattagagaaaaatcatctatagttttataacctaaagatgactattgctaaaaattaggtgaattttcttctatattttaataagatgaattgctttttgagcacgtgtgctcttacaattgtattcttacgagtgacgtatttgactactaaaaagtttgatttttgtatgcgtcaaaaaaagtaagggcaaacaccaaatgttatatatttatatatatataaatatctaatatatataatatataaatatataatataaaatatataatatataaatatatattatataatattatataatatataatatataaatatatattatatataatattatataatatataatatataaatatatattatatataatattatataatatataatatataaatatatattatatataatattatataatatataatatataaatatatattatatactatatataatatataaatatatattatatactatatataatatataaatatatattatatactatatataatatataaatatatattatatactatatataatatataaatatatattatatactatatataatatataatatatactatattatatatagtatattatatactatattatatagtataatatagaatatattatatattgtatataagataatatattatatattgtatataagatataatatattatatattgtatataagatataatatattatatattgtatataagataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatatattatatattgtatataagatataatatattatatattgtatataagatataatatattatatatatattataaatatgtatatttttatatattattataaatatatatattttatatatattattataaatatatatttttatatatattattataaatatatatttatatatatttatatataaatttacatgtgttaaaaatatgattgtgttcttgtattcttacaattgtatacgtttcccatttcccacttaatatgaaaaaaatacactcatatgtaatgttcttagagacaactttaagatgttatttttaatggctgcatggtagtccagctagctagtaagtataccatattttgcttagccagtcacctacttttagacatttgactcattccatatttttgttattataaattccatcaggatgtatatttcagtacattaaagtttccttgcatttatgattatttccttagaatgaatttccagtgtggaatttctaggtcagaaaacataaacagcttaggattcttgatatatacatgatcatgagatattttccctaaatggttattccaatttacatgctcacctgtaatgcatcagtgtccatttcaccacaccctcactagaagtgggtattgtagttaagaaaattttcccttgacatttggcctgttattctttattttatatttacactctatctctttattttccacattttatattcctttggttagtgactgtcattttatatggttgttaagctgttgtatttcctcccatgatttggctttttgtgtatttttctcatttaaccagttgaatcatactttttttaaacacactctatgtgtatatatatatatgtgcactaatccttgatctattgcaaggtatcctttcgaagtttggtgtttgcccttacttttttgacacatacaaaaatcaaacttttttaacacattgtaaatttatatatatactaatccttgatctgttgcaaggtatgttttctaagtttggtgtttgcccttactttttttgacacatacaaaaatcaaactttttagtagtcaaatacgtcactcgttttctttgtgtttgatttcttccttggctagaaagtcctttccccttgagatatgtcataaaacttcactgcagtttttgttttaaattacggttttgttagtttacatttacctctttaattccatttggagttgtattttgatgtggataaaagatctaatttgattttgtttccagatagctagcaattgtcctaatataatttataaatacaacttccattcttcattgatttgctagccgactttaccatatattaaattcttatatataacagttactgtttctggactatctatttgtctcaattgatccatttattcttgcactgatagcactatagtatgataatgttttaatatattttaaaaattatttgctattcttatctgttggttcttcaaaatgaaatctagaatcattttattaagttaaaaaaaattcattggaccaaatgttttagctctcacatgccagtgagaacacatgatatttgtctttctgtgcctggcttatttcacttcacataatgacttccagttctatttacatttctgcaaataacaggatttcattctttttaatggccagatagtattcaattgtatatgcatagcacattttctttatccattcatctgttgctggactcttctatatcttggctactgtaaatagtactgtgataaatgtatgggcgcaagtatccctttgatatattgatttcctttccttttgatagataccctgtagtgggattcctcaatcatatggagatagagagtaaaatgatagttaccagaggttgggaagggtggaaggcgatgaagagaggttggctaatgggtacaaacagacagttagatagaagaaataggttctagtgttcagtcgcacagtacggtgactatagttaacaatatcttatgtattttgaaatagctagaagagagtacttgaaatgttcttacatatagaaatgataaatgtttgaggtgataaatatcctaaatattcaaatcccctgatttgattattacaatgcatacatgtgttgaaacatcacactgtaccccatgaatatgtacaattattatgtatcaaaaatttttttgaaaacaccattggggttacattaaatttattaataaactaagaatgaattgtcatctttaaataatttagtcttcccttcccataacataagtctctccatttataatttttttgtttatatccatcaatcaagttttatagttttctttttgtatgtcttatacattttttgttatttcgagttattgtgtgtatgaatgtgtatgctgatttttaaaaatcataaatgggatctgtttccactatattttctgtttcataggaaagctactgattttatgttctgttcttgtatttatccagtgtactgaatgctcttattaatgcagatagttttttttttaagtttattccctttgttttttttagatacatcaagtttcttttcactgaggtacatatgttctctcacatttcttcccttctcaccctcaatgtagacagccattgggaaagttctgactgcccagtgggattgatggtgataagacgagaactaatttaaaatatttaaaataattagctcaaaaaatagtttatttccatagttggcatccttctggacatatctgcctttgtttgctacttatctgatggaagatttggaagaagaaatgctgttataattctttagcttcaaggacacataatgaagtcatttgacatgtatgtctttagataaatgcataattatctttttgtcctttaagttttaaagggacaactgggaataaagtgcctgtcaaacaactgaactggagaaatgggggaggagcagtgatgaaataaaattccagtttatcagttgcaataaaggggaacagtgtggcaaagaacttgaaattataacttaacttcatttagtgagaaattacaacttgcatttagtttttgaattcaattggatatgtgccttggtgccacatttatcttcatgataacttaggccaccaacattattttcaatttcctgaatacaatccagtggtaaagtgagcctgaaagccagcctaggattgtttgccacatataaaccaccgaatggataattcacggcaaataagccaagtactgactctggttgacaatgtaaaattaaagttgcaagattagcctgaagatgtcatttagcttaagcaaagggggagtctgggttgatctctttcgggctctccccacctggcctcttcccttcagctccctccactgccctccttctctcagtggacagttctagctccatgtccaagcagattccctccctttttgagaattgtgcttttggaattgtcttaaagaccaatttgttaatacattccctctagtataagagaggggcagcacagaatggtggttaagagcccagatcttccagccagatctctgggtgtgcatcccagctctgacccttaactagctattttcccttgggcaggttactttaactttctgtgtctcaggtttcttacctgtaaaacggcagatggtgataatgagagtacttacctcacagggttgttatgatgattatgacatgagttaatatttgtaaagttaacatgtaatatgtgttttttaatatgaataaaagctctataaataattgtaatacaaagttagaacatcataagtatacgtaaataaaacttgatatggaagttcaggggaagaagtggttatatttattttcatgactcatcaaaatatcacatagttttaccatcacacttgaagttgaatgactttcaactgtttcaaaaattaaaattctctctgaaagaataaagtttgggccattgtaagtttggaaagctcttgaatcagagtatagtctcaaaaataatggctttgtgtaggatactattcctctggatataaaagttctgaaacgtttgttaaaaatcattatagttgtgtcttgaattttgtatgtagcattagttcgtatagacgtagagggcataggtactggcttgctttatttgaaatgtcatgaagaagtcagatgtagctaaatgttttcttttgtgtagtacttgacgtggtataaaaaaggaattgatgtggatttgtcagttctaaaccaggatctgtccccaacactgacccactgagaaaataagaaataagtcaggttggttgcttcttgcttcttgtccatttctaacctggacacttttttacagttagggacaacttttgatgaaataaagacaaatttcaatatcagcagagactagattaacacatgctttatagtaattaaaataaattaaaggcaatgataaaactccaccgttctttaacaattattcatgttctgatttttttggtgatacattttaaactctaggattatcaaaaagtccaaaaaagctttaatgagggaaggaagttaaaagtacactacattgctggtttgtctgtattaagggagggagtcagaggaaatataatcctgaaggggatgtaacaatttaaaaaaatgaattacatttttatgagttgtgatttgcttaggctaggtttgtaaggctccaaattgtaattctgcttgtttttcttaaaaaattagtcacttaaataactacatgaaaaaataacatgcaagaatgcatttacgttagtttaaatttacttctagtttatatacacacagggacagacagttttgaatagttgtaatcagagtggcatccccttgtgcccactttttacacatactgtcattttatttttttatttttattttttgttttgtgtgtgttttttttaatactttaagttctagggtacatgtgcacaacgtgcaggtttgttacatatgtatacatgtgccatgttggtgtgctgcacccattaactcatcatttacattaggtatatctcctaatgctatccctccccccaccccaggacaggccccagtgtgtgatgttccccttcctgtgtccaagtgttctaattgttcaattcccacctatgagtgagaacatgcagtgtttggttttctgtccttgcgatagtttgctgagaatgatcgtttccagcttcatccatgtccctacaaaggacatgaactcatccttttttatggctgcatagtattccatggtgtatatgtgccacattttcttaatccagtctatcattgatggacatttgggttggttccaagtctttgctattacacatgctatcattttatgtcaacatagtccacatacttaaagttttctggaaaacctaagactctaacatttttgaattttggcataagattttatttgtttatttatttatttatattttttgagacggagtctctctctgtcgcccagcctggagtgcagtggtgtgatctcagctcactgcaacccctgccttccaggctcaagcgattctcctgcctcagcctcctgtgtggctgggattacaggtgcgtgccaccacacccagcagttttttgtttgtttgttttgtatttttagtagagacagggtttcaccatgttggccaggctggtctcgaactcctgaccttgtgatccacccacttcagcctcccagagtgctgggattacaggcgtgagccatcgtgcccagccagcattaacattgtaaaccttcacctttgacatagaaagtgtaattttgaaccattgtttctgctataattcctttatttttccctaatttatatatttatttctaaactggcaaaattgtatatatgtattgtgtatgacatgatgctttgaaatatgtatacatgtgtaatagctaaattgggataattagcatatgcattacctcacatacttacattttgtgatgagaacacttaaaatctactctcttagcaactttcaagaatacaatacattgtttttaactatagttgccacgttgtacaatagatctcttgaactttttcctcctaacctaaatcttttatcctttgacccaaatttcccaatccccaccctgcacgcccctacgagcccctggtagccacccaccattctactcttggcttgtattagttcaactttttaagatcccatgtataactgaaactacgcggtatttgtttctctgcgcatagcttatttcactttacaaactgtcctccatattcatccatgttgttgcaaatgacaagatttcctttgtgtttaaggctgaatagtattccattgtgtatatacaacatattttctttatccattcatctgttgatagacatgtaggttgattgcattatgtcttggctattgtgaataatgctgcaatatacatgaaagtgcagatttctccttgacatgatgatttcatttccttttgatatatacccagcagtgggattgctggatcatatggtggttctatctttaattttttgaagaactttcataccgttttttataatggctgtactaatttatattcccaccaacagtgtgcaagggttcccttctctctgcatcctctcttgttgtcttgtttttgataataaccatcctaacaggtgtgaaatgatatctcattgtggtttcatttgcatttttctgatgattagtgaggttgagcattttttcacatacctgttggtcatttgtatattttcttttgagaaatgtctattctggtcctttgcccatttttattttattttattttttttgcaatggtgtctcggtctgtcgcccaggctggagtgcagtggcgcgatcttggctcgctgcaaactccacctcccaggttcatgccattctcctgcctcagactcccgagtagctgcctttgcccatttttaaatgggattatttgttttctttctattgagtaatttgagtctcttatatattttggatattaactccttatcatatgtatggtttgcaaatatattctcccattctgtaggttgtctcttcactctgttgtttcctttgctgttcagaagctttttagtttgttgtaatcccatttatctatttctgcttttgatgtctgtgcttttggggttatacccaaaaacaattcccttattttgagcaattattccttatttaggggtgcttaggttagttccatttttttcactattaaaatagggctagtatgaaaatctttgtcaaattgcgttttcctcttgacttgtttccttggagtgtatgaagataagcaaggttatgcagtcaaaaatatgtatggttttataggtctcgttatataacttgccagtttgaatagcgattttccatggacagggacagagtatgttttgtttgaaaaggcatattcaatattttagtttaattttatgttacaaaattactggtttataatagaagctatagaaaataaaactaagaaatattattggggaagaaaggaaaaaatggttcagaaacactgtcctgtgaagactgaaatgattgacaaaccttcagcttatactaaaataaaattgcattcttaaagcatagactgaatgactacggaggaggtggcacagaactgccctgggcaggtggaagaagccaggttgacaacagggaagttgccatcaatattcccaatgagatgtgggcattcgctttacattttaatcagtccttctgtaactttaatgttcatacaaatcacctgggcatcttactaaaatccagattctgatttaacaggtctgggtggggcctggaagtctacatttctaacaagctcccaggtgatgttgatgctgttgtcctgggaatgcaatttgagttgcactgttttagatctcttccttgtatgacatattatagtaagagttgactacaggggatccttggtcagttacttcagtaacttgaaagtgaaagatataaactgctggcctatttgaggggtgaaacaattttgctcattcagaaattggaggggttgtggggagaaggaaattgttaatattagatgagttaatcatgagaagttttatgtaccattcacaccaggttgttcagagactgaaggaggtacgaagttttgaagtggtactcaggttcctgctacttaactgaaagtgagataagatcagattcgttaggaaacaattctcaaaacagactcatttactttgactaaatgcgtctgaatgatagtagggagatagagtcattgtattttttagagacccactgttttagaaagtggaaaacttgttgcttaccattctgcttatcttgttgctgagattttaaataatgaatctccacatcacccttatgatactgaattattgccattaatcatttctcatagggaaaatggaactaagaacctatgctgtttcactgcttccatctccattttgctatgtggctttaagaaaatcacttaaaggcttatgttgagttcccatggtgaaaaatggaaatcaaagctcttgccttgttccccatagagtacttgctgaagttagtgggctttgaggtagatttcaagtgtttaaaaagacaaaagactttaacattgtaatattgtatatttattcagcatattatatataggcatatatcaagctattttatatatgatctaaatattctggcaatccttcgtaaaaaataaaacatcatataatccacatcagtagttaaattgaccttttgttcagtgtcacgaatcaagtaaatctgaatagtgtgtttcagatttgttttggccctttaggtaatcagttctgatgcatattgatgaaagatatagtaatttttttttttagatggagtctcactcttgtcgcccaggctggagtgcaatggtgcgatctcagcgcaccgtaacctctacctcctaggttcaagtgattctcctgctccagcctcccgagtagctgggattacaggtgcccaccaccacgctaggctaatttttgtatttttagtagaaatggggtttcaccatgttggccaggctagtctcgaactcctgacctcaggtgatctgcccacctcagccacccaaagtgctgggattacaggcgtgagcctaatttaattcacatatttaaatacttttatttccaaaggaggttaatggtaaatgtgatcatcaagtcaagcatgacactctgcttgtaaacacattgattttaaccagagttcagtgcatgtcctggctaggtgtggtggctcacacctgtaatcctactactttgggaggcctaggtgggaggatagcttgaggccaggagttcaagaccgtcgtggtcaacagagcaagaccctgtctctgcaaaaactaaaaaaaaaaaaaaaaaaaaaaaaaaattagctaggcacagcagtgtgcaactgtagtggcagctactcaggaggctaaggcaggagggcaaggctgcagtaagctatgatcaccctactgtactccagcctgggtgacagagcaagacaccattaaaaaaaaaaaaaaaaaaaaaaaagcatgtgtcctaaccaaaagatctctattgacccaaacttgtgcccaagaatagcaatcagaaaatttatgaaatgaatgatttagattcacattcaattgattcacaattgattttgattcacattcaaaaactgaaacaattcattataaagtttaccttactgttttatgaggtaaaattttattaggcaaattaagtaggattactatatatactaaaatataacaaataatctatatccagtacagtgtggggatcaggaactggggatctagaatcaaatgggcctgattcaaatcccatttttgcttcttaatctctagactgattttggttacttaacatctcaaagtctcagtttccccatctataaaataaatattacaacataaacctaataggatttttgtggggtccaaaggagataatgcatgtgctagaaacttaactttttatcctcctaaattcacacgtttaaacccttacctccaatatgcttgtatttggagataggacctctaggaggtaattaatgataaatgagatcataaggatggggctgtaatctgataaatttggtgaccttatgagaagaggaagaatgcatgtacaaagaagaggtcatatgagcacacagcaagaaggcggctgtctacaagccaagagaagaggcttcagaatgaaacataccttaccagcaccttgatcttggacttcccagtctccagaattgtgagaaataaatttctgttgtttaagccaccctgtctatggtatcttgttatggcagcctgaacagaccaatacagattttggtactgagaggaggagtattgctgtaacaaatacctaaaaatgtggaagtggccttagaactaggtaatgagtagaggctggaggagttttaaggtgtatgctagaaaaaagcatagacggctgtgaacagaatgttggtagaactatggatgttgcaggttattctgatgaggtctcagatggaaatcagcaacatgttactgcaaaatgggagaaaggtgttccttgttataaatggtaaagaacttgactgaactgtgttctagtattttgtggaaggtggaatttgttgagtaaaaaaattgactttttatctgaggagatttctgagcaaaaagttgaaggagtggctcagtccctcctgactgcttatggtaaaatacaaaaggagagagatgaattgaagaaggaattgttaagcaaaagggaactggaacttaaacatttggaaaattctgagcctttatgtattgcaataaatgaggaagcttgttctggagacaacactaagggtgtggctggactatctgtcactacttaagattacttatgatgttaaccagccatctgagcagaagtcaggaatagagtttggaaaaaagcagcagaaatattaccagtttggaccaaagagaacaggacagtatggtatagttatttggctgcaaacatggtttatctttcaagaaaagggaagaacgaccctgagggtgattcagagataaccagggctgccattcctactataggcccaaagtgcacaggcctggagggtaaggctgcctctaccttggtttcaaaaagtgagactgacatccaacagagccacataggtggggccatcaccctagccaaaggatgtggccaccttacagagctgtgggggtgatgctgcttttccagtgaacctgaagggcagaatattgaatcgaagaggattattcttgagccttaagagctaatggagtttgccttgctaggttttggacttgcttgggacctgtgacccctttatttcttccaatttctcccttttggaatgggaatgtctatcctcttcctgtagcaccattatattttggaagcacatagcttgtctggtttcatagtttcacagctgaaaataaattttgcctcaagatgaataatactgctagtctcacccacatctaattttatttagatgagactttggactttagattttaagttgatgctagaatgagttaatttcttttgaggccgttgggatggtataagtgtgagaaggacatgagttttgggggtcgagagtggaatgatatagactgaattgtgttcccccataatatgtttaagctctaacttccaacatgactgtaattggagatagggggtaattaaggttaaatgagttaaatcataagggtggggctctaatctgataggataatcataagtgtggggctccaatctgataggattgggggccttattacaacagaaaaggctgtctgagtacacagcaagaggtcagctactcacaaggcaagagaagagggctcaaaatgaaacttatgttgctggcacctcgatcttggactttccagcctccagaactgtgagaaagtaaatttcttttatttatgccattcaaggtatggtattttgttatggcagccaagcagactaatacagcaagtaaaactcttggcatgtagtagaaatcaattagacaaatatacaatatagatataaactgagtaatgggaaggaatgtttaccccatttaaaaggataagctgcttttaggaaaataaagttacaactaaggcactttggagatagtcctagtttacagaattttagagttgctcttccacaaaagtataatttaaaacaagcagcacttgtttttaattcatatattttttactattacttcatttataatatattatagggtaatatagtaatacagtcatgtgcaatatagcaacattttccttaacgacgaacagcatatacaatggtggtcccataagattataatggagctgaaaaattcctaccacctactgatgttgtagccattgtaatgccacagcacaatgaattacttatgtatttgtgatgacactggtataaacaaaccgactgtgctgtcagctgtataatagtatagcacaggccaggtgtgatggctcgcacctataatcccagcactgtgggaggctgaggtgggtggatcacctgaggtcaggagttcaagaccagcctgaccaatatggtgaaattctgtctctactaaaaatacaaaaattagccagccatggtggcatgcacctgtagcctcagctactcgggaggctgaaacagaattgcttgaacccgggaggcggaggttgcagtgagctgagattgcaccactgcactccagcctgggcaacagagcgagactctatctcaaaaaaaaaaaaaaaaaaaaaaaaaagaaagaaaaagaaaaagaaaaaaatgtatagcacagacaattacatacagtacacaatacttgataatgataacaaattactgtgttactggtttatgtatttactgtactatacattttatcattattttaaaatctactcctacttatataaaaaaaagttagctgtaaaacagcctcgggcaggtccctcaggaggtattccagaaggcattctggaatatgaatatcataggagatgacagctccgtgtgtgtgactgcacctgaagatcctgcagtgggataagatgtggaggtggaagacagtgatactgatgatcctgaccctctctgtaggcctaggctaatgtgcgtatttgtgttttagtttttaacaaaaaagtttaaatagcaaagaatacataaaataaaaattttgaaacagagaaaagcttatggaataaggatataaagaaaaacagttttgtacagctgtacaatgtgtttgtgttttaagcgaagtgttataaaagagtcaaaaagtttaaaaaaatttacaagtttataaagtaaaagagttgaagctaagattaatttattattgaagcgatacagttttttttttttgagacaatctcgctccgtcacccaggctggagtgcagtggcgtgatctcgtctcactgcaacctccgcctcctgagttcaagcgattctcctgcctcagtgcctcagcctcccaagtagctgggactacaggtgcgtgccaccatgcctggctaagtttttgtatttttagtagagatggggtttcgttgtgttaaccaggatggtctcgatctcctgacctcgtgatctgggaaatataaatattttaaaataaatttagtgtagcctaagtttacagtgttcataacattctagtagtgtaatgtcctaggccttcacattcactcaccactcactcattgactcacccagagcaatttccagtcctgcaagctccattcatggtaagtactctcaacaggtatagcattctttatcttttatactatattttactgtgccttttctatgtttagataggtttagatacacaaataccattatgttacaattgcatacagtattctgtacagtaacatgctgtacaggtttgtagcctggagtaataggctataccacatagcctaggtggtataccatataggtttgtgtaagtacagtctatgatgtttgcacaacaacgaaatcacctaatgatgcacttctcataatgtatcccccttggtaagtgatgcatgactgtggcaatattatattgctatacattataatagtaattttataaaaatatagttatattcaatttatagtattatatccttatactattgccattatatttataacaaatattattaatattaataattatttatgtgggcctgatagtgtattatcccagtgaaatgttttcaccttaagtttcgatatgtacttaaaaataagtctattgtttgttaaaactatctaataattcatggttttatcaattacaacaggtccctgttgtagtttctttctgtccaaatggtctctcaacttgacaaatctttaggagcatgaatttccatatttcaaaaaatgaaaagataaagaaatctcactggaaactgtggttgggcagatacaatatggagacaagttagattcactatgctttacttcctatgaatgcaatgacaccatatacgtgtgtcctagtatatgtgacatttatatgtaatattaagctcaaatttaaagtatccattgttcttttggaatctttcagtaatggaagtttattctttcacaggtatcacggttacatttatacataccgagtgtcccagacagaaacaggttcttggagtgctgaggtatagttgtatttatttttgcttctgggggtgtcaaggaggtatttgaaatttaggctggttttataaaagagcaaattatacattattaagtattcataaggtttaaatctctaaagctccaatccaaaattgttcatggatcattaagaaagctttagagaattttggtcccagtcctgtttagccatcattttgcagagttgtatgactttgggagaaagataaaaaagttgaagaattatgtcaaacttttagtgactatgtgaaatcttagcatatcaaaagtaggtaaaataattaaatgaacaattatttaccaaatgataccaatatgagtattggtatcgtgggagattaaaaaacatgatgcttattttctaagagactacaatatacttgggaagttataacttgaaattaaacagttatgagtggaagaaactaggctttgtcaacaggtgaatctgggttccaggtctggtctcccctcctctctgataggtctatgatcttgggcaggttacttgacttttctgtgagccagtttcttcatttgtaaacggagcctaagaatcctcccttatgcacaaggctcaatttgaaaagtaaataagataacacacataaagaagctgtttgccacaaggcctggcacacagtgagccctcaaaaaagtgaactcctgaaaattgccacaactcctattaataactcaatctgtgcatttaaaattttctgaagtctagacttcaagaagttaaaatagctctcacgtttactgatttatcagtaagttggaaagtataaattacagaccacaaatgttttgaaccactgagatgaattaggccaagttttcaaacacacttttgctgtattatgtaaggatcattaaaactataatactaactaaagataaagttataccatttctaattgaaactatttatacctgtttatttaaaaaattctctgtatcactgcagagatgattgaataagaaattaaactttattatgaagaaagttatgtgtaaaatatactgacaaacacacacacacacacacacacacacacacacacacacacacacgtttgtatattatttcgccagaaatagctcttctccccagagaaatacccttcagctgctgaagaatattatgtaaggaaaggatcttaaatgcttagggtttaacaactttgtttttcaacttgttttcctgcattttgagtataacatcatatgagattgttacatgcttgtgatcatgttaaagaagagagggcttattgaacacaaatgccccctcatcctgttgtctgatctgacgttgtttatgtaataatattgtaattttctgcaccaagagagcagaagattggcatgacatccgcaaatagaaaatagtttaaaaaattctttaatttttgaaatgcatattgcatttttttctatctactaaatttaccttcttagcagtgcttttctaaggtgaaaattaaactagtgtatattctcagagctcataccacctgactggaaaaaatttctctagagcatattgaagaccagctgtgatctaatacatgtttccatggataactaagaggtgacagtatgggagatttgcaaatttgaagaatagctgagttcagtgacaggatgagagttgtcagtggtacaattcttgtgataaatgtattttcgaaactgggtaaatgatagatattaatactgatttttggaacaatgttttagtttgccatgctgcaggaaaaatcaaggcagtagcatgccaccatctgtgcatatattatgctagaaatctaggtaagtgagatttgttttaaagagtgtaatgaaatcaaaccctggccccactgaattatgaaagacagatatcatgtgtttttctagttttagagagacttttaggttaaatctttgcctagtgtattatcttatatgactcagactaaaagtttgttacattgttaatttagataattccacaatctactttcatttattaatatgtgatttgttggcaatacattattaaaaatgtactgacatcaccctgttgacatcagtgtcttcaggctttactgggtatatgatcaggagatcagcagatgttaaataattgtccttattaatctaagtaaaacactgtaaaataggccagtcatttgcttatgaaacatcagatccccaattcaaatagcttccatacttccagtgctattattcatttctgttagcatggataatcaagtgttagctacatatcagtacccataaaaatgttgcttctctgttttgttttgttttgagacagagtctcactctgtcgctcaggctggagtggtggaatggcccgatctcggctcactgtaacctctgcctcccaggttcaagtgagtcctgtgcctcagcttcccaagtagccgggattgccaccacacctggctaattttcatatttttagtaaagccaggctttcaccatgttgcccaggctggtcttgaactcctgacttcaggtggtccgccggtctcagcctcccaaaatgctgggattacaggtgtgagccactgtgcccggctatgcttctgttgataaatgactttacaagccacaagaagctaaaaagatgtgtggtttgaaatctttccacactttaggtgtgtatagtttttcttctgtttgatgaccctagcttcgctagatcctgtttggcccagttctaatctgaaaggcaagagactgggtcctgggattctgagccagttctgcctctggttgtctgtgtgactttgggcaagctgattaatttctttgcattcatattttcttatctgtcaaatgggaataactgaatcagccaataactgccattttgtgaggaaatagtgaaggcaagagataggaatgtgctttgaaaatgaaaaagtgcactgaggaaagtataaggaggcaatttgtgcctatgacctgcatttgcaatttggagactctatcttggaaccaacgaactgtttggacttctgcaagaatggccatgttattttggatgagttctcaatcgagctttaggaaggtggagggtaggtgagagagtggggtggagctgggtgagagagtgttctacatctactgtgaacatatgggggaacactaatatagagctaaaaagaatttttgtcatgttttcaatgaaaaattaccccaacataaggaaatgactgagagttactatggatagtgtagtatgctatcttcagcataccactatctagctgacagaagtcttcatgctcgccttcatgttttctcattaaatgctaaaaaaacaaacagctcccacctcaaaaatctaccagatggaatagctgaaaaacaacttaaaaaaaaaactagtcattgttcaattgctcatagcaatactattttattttacgtaaaatgacaggtttgagctgatgcctgaagcttggctcataagcttttgcaggaaattgttgttgatttcaggcagtgtctttgcaagacaactgatgtcaggaaaggaacacattttaatagtcacctgcaaataactgtctctttaaaaacacacaaataaataaataaaggtgaccttatatagtctttcattttcatgtcatagagaaaaccttgttacagtgacgtgctgatggagagaacaattttgggagtatagggaagtttcccaaggaggaaaaaatttaatgtgaagaatggcgcaggaaatattgtgaggtgaaagagtatgaggactgaactagccgtgcactgtgtgcatcataacagccaatttttaatttcctgtgtagcattttatattgtgggatgatggcagggaggatgggttgttggtttttcttttgttgttgttcctcaggctttttattaatgacctgtaggatctgtttttttgtttttgtttttgttttttcctgtttaactgcatcccctctgttggtgaattcattgtgggtaatggcctgtatacccttagaggtttgagatgtctgatggggagcaggcaggaagggcagggcaatgagcaagagcttgtacaaactaataccacctttgggagaactgaaatgacagctcattagctcctcttgcagggaaattcagccaaccaaagtaagctcttctggaatgttgtttttccttcttccttatgttttcaaatatttcaacaagttacacaaatgttacttctcttagcatccctagcacattttgtaggtctttttgtatcattatgagataggtaaataatttgcttggccttttattttccagacagcacctggggtacataaaagatatttccggaaaataaaaaatctcatttcagcatttcagaagccagatcaaggcattgtaatacctctgcagtatccagttgagaagaagtcctcagctagaagtacacaaggtactacaggtatgatttcctcttaatttttgacagggtttggaagctcagagttatgagtcaacctgttcataaccatataatcaattagaagttatgtaagaaaaatgcagtgagaaagtagatgtagccagcaagtcaaatgagaggtgacaatttatgtgctataattttcatctattattctaataacttttaataaatctctgtaaaaacatcaaaaattctataagcccataacattttaactgctcttgtctgtctcatcttgttctttcctgtccctttaataggtagctaagtatgatttcacttcactaattcagacacaaataatgtgaaagatggtataattcagagaacacctgggctgtcctttatctttgcttagtaaactgttttttccttcagggacatgaaagctaacgttagcctggcacacatgattctgatttctgaattggtggtgcttgaattaatgacatttttctgaagcaaaggaaattaaatagtgcactttattgttccactggcacatattgttacatatcctgagcaaacctattttagtgtatgtgtcgtgctaaagactgaataccagccaatgtctgtagctatctgatacgtgactgtttactcctctattgaatggggtttatcatttgtttggagtaagaggataggccttgattgaaacaataaatatttatgataaaagaaaacgagtccctttttgacagggacctaggctcaggcataaactgacaattagactcaagtggtgaattaaattaatgaatagttagcctttataatacaaatgcaaatagagctctaatttccaagttggctagttgtttttttctgcctaatattccattctttataactcagttttaaataatagttgcttgaggtatattactgtgttgtgtcattgtgagttttatgcagttggaaattttataagtttgagttaatctgtaattttaatagtttgtaagtttattttttcttgatttttgttatttttctttagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttacctaatttgtcttgaaatattccttataattccttataaaatattcagagactgatgctattaataaaccaaataaaggattgatgattatcttatcggagtgattccctggaaaaggtaagtgcttttctgattttattgctgtccaagttcccggttgatgagcctacttcctgtcttctttggctggccttttattcatcaagtttttttttttttttttcaccttttctttcccaacatgagcatccttgctattttccagtacgtaatcacttgcacctttacagaaaggtcatatccttgctgtatctaaaatattgccatgctaacatattgtaagatgctgagtcaaggtagaaaaatgcacaatatatttccaagtgtgcagctctcttcagaaaaaaaaaaagtgtgtcagcaagcccaaaaggaacatgacagcttatcaaatacttattcatttcctctgaaatttgttcttaagagataaggtcagtagggagacaagcttaggtaattgtctgtttggctgttacaggcagggaacctttgtggtagtgcacaggtagaataagtctatagagaatgcctctgattaagtcctctgctataaataaagggctggatttaagatattctttcgggtagaatggacacagaattaaaaatgtgagaaacagctttaaactctgttaataatgtttcaacatcagcttatgttttatttgattcacttcgttaagcttagaatccaaagtctactactagtaaaacccagatttgcccttgagcatttcaaggttataggatgcctggtcttcctgttaggatgctatacattcaactttgacacctatgttttctcttgcagtaaatgggataccactattttgtagtttgcaactaggggggaagttaaactacccagtttggacattttcctaatttggggtgattggccaaacttgtagtaaaaggctgaattcttatcattaggtcatttagttcttaaatgaagattttttttttaatgtagcaagatataataaggctgactaactggatagagtccattaacatatatggaattgagatatatatatacatcttggttgcacacatacacgcagaaatagaactgttttctcacaagatgacaaaaggctatactacgtatcacattcagtattggacagagagagtaaaagcaggaatgcataagaactgatttttttttctttttctttttttagtcacctggtgggccatttaaacattttatttatttattttttaatttttattttactttaagttctgggatgcatgcgctgaatgtgcagatttgttacataggttacatgtgccatggtggtttgctgcaccatcaacccgtcatctaagttttaagctctgcacgcattaggtatttgtcccaatgctctccctccccttgccgcccaccgcctgacaggccccagtgtgtgatgttcccctccctgtgtctatgtgttctcattgttcaactcccactgtttttcatctttgtcactgattatccacgtgaccttaggtaagtcagtctgttactgttactgcatttgccaagtaggaataattaagtcgtactaacctcacaagattattaaggtacaataatttacatatatgtgtgtgcgtaattacatatatgtataactttaaggtagtaatattactgaatgtttaaataacattgactgatagtcacagatctctaaaagggagggtgaatagggaaggaatatacaaacgtctcctattataattctctctctataggagctcctgcccttttaaaaaataccctgagtgtgaggtgggatgcatattttgaaaaaaatttccagatgattgatactaacaaccccctacccccattgttttttactgatgggttgtgttgagatgatcaaggttgtcttctgctccatgagtcttttcactctctctctctctctctctctctctctctctctctatatatatatatatatatatatatacacacacacacacacacagacacacacacacacacacacacacataaaaaagcagcagggcattttgaagtggtgtaaattgcaggattccaagtttcagtaatgggttgtttggactacatgtgctccgcgagtatcaagatgaatttttgaagatctgttggccagatttcccagcgtcacttgtaaatgtcttcttgtgaaaaacaagtgccaaatggcaattgtaattgcataggatttttttagtgtttcatgattgcctcccctccctgacacccttccccactggctgctgccccaacatccattattttttgccagtgcatttggacaccctgaactcctatatatctctcccaccccgtttttataattttttattttctttctattgctgagaaaggcaccaaaaggagagggaagcctttttaaaggaagtcacagcctagaggcatttaaatttgcagcagctactcttctttgtttattaaatggtcacttgtgtcagagatcctatttgtatgaaaaataaaaatgaagagctgtctgcctaggattagtgactttttgatttctgtacctgcattttcaagatggtgtggttttattgttccctgttagtgagccacttgtcctatctaaggtgaccagactgatttgagaatgcagtttggcgcataaataaaatgggacacatttttcattggcaattttattttttaaaaatgaaatattcaaagtacttttctttcaaatatcaacacataatgtttaactttaaatatttacagcatgttgttgtgatgctcttgtagaaaaatgcatgcttctggcctgaaagccagagcaaaatgcaaaagaccatttaactgcagccagagaacatgaacctgtacagtatccagtcacttttcagcacaggagagcaggaatacaaaattggaacctattgtttcctagcaacatggctcagaccattataacacaattttcaatatgattagaacctctacctgttgttatacagaaactgaaaacttggcatacactgtaaacatctttacttttcatgagaaagtaagcagctaaaaagaatgtttttctgacataaaggctatacttctctttttcgccttctttcttactgatgcttttgccagaagaatagtaaagatttagacgttgtcatgattcatacaagtaaaatatttttcaaggacacaatctgatatactaacatttatttaagaggttaaagtccaccactaaatctaaggaaagatttttaactgccaaacacatttcctttgacaaataatgtaagatgacaactgccaagacaaaatccacagcaagtttaactctaagtattttcagttactgtttagaaagtaatttcttcttatgaacagtagtatatttggtccttaatagctttcacatgaaggacacactgaaaataatagtcactatttatggttgaattcttttttgttgtttgttttctgtatttttaaattttactttgcttttttttgtttttttgttttttgcgctttttttgttttttttgttttgttttgttttgttttgttttctttgcagaagaaagaacctttatagaaggctgtggaagagctgaagtactagtcaggtcagctatgtgtatgtgaatttcttcaagaaaacaggaatgttccattccatctgtagccttatgtctttccacaagctatatataatatgctccaatgtctccaaaattttcttttcaatacttcgttactgtacttttgcttctattaccaatgaactccattacaatcacccttacatgaacacatcttcataaatgcaaaaactttgccctgactctcttaagtgatattatagtggggcctggtctagttaaaaatatatttttaaagaaaaaaaaaagaaaaagagtcaaaataacatgatggaatgcttgaaactgtgtcaacagtgatgaaaatgtctcatgaaaattataacttaatttcatacctgtctacataggtagcatgtgaattccaaattatacattgtcaagttttcatacatttggctatgttgtatatattatatatatgtagtctatatattatagatcttctagataaattgacagtaaaggacacacttattttatacattttttgggttaaaaataaatcatatacttatttatatggtaaaagtgttttgttgcaagttagtatgaattgagatttatttccctttccttcaggagtcatgcttctaatcaataacgattagaatgacaactaaaagtaaacatatttaaatgtgttaaactttgaacttttcagttcatttggatctctagactgtagtgcaagagtgaaaacaaaacaaaacagaaaagcacaaacaaaatgggcttaagtaggaaaaagaaacaaccatggagtattccctgcctccagcccagaatgttcttcataggagagtccaactactatgctctcactttaacttactcgaatggtgtgtggctgtgcagtgtcagccatctgtctgctgggtatgagaaattcatatgtttctctgaaaaatgcttttactttcatcaggaaatgcaaacgaattgttctttcaataatttaaactgcagaactgcaagtcaatgaaggcattctttctattcagctgaataggaagtgatatactcaatatctccatcttcttcttaagaaatgccaaaatgtttctcttcgatttactactgattagtagttttgttttttttttctttcctccctcaagctttaggagttgtaaaaagaataataatagttcaaggcagtattaaaaccacagctgtaagtaataaaaagtgcatttcctgaatataatacaaatgtaactttaacaaactaaaggcacgaaccaaccaaatacgtattacaaactagaaatgcacagttcaaggtaatcactattaagtaaaagcttcaaatatttgtttctaatggatatttaaagcagtttgaaaatgatacatcatcaatgaattgcaaaaacgtataattgcttaaaatataagcaaaatagactctaatattgacattttggatttgtgataaaatacataatcacatttatgaatgcactctctatatacagttcacaaattatttttccattaatttaaaagaacatcagaggttctaggaacttaaggtccatttttaggttggtgtggaggtattcaaattttcaacaagtttgttagtaattttagaattccattctgaataaatactgtaccattaatacaggcctgattcagaaaaaacccaataatatgattttagtatggattagcaatatatcaagctggtgtgtttccagttataaagagagatgagttcctcatgaattctgtctctcagaatacatgtgtaagtggtattctaacccgaaggttttgaaaatgaaatgtttgaatacacccttccctactgtttgccagggtcatttcctttcccttgctttcctttgtgtagtaggaggcagactcttgaaaaaccttaacatgagcttatgactttgcatattttcaaagaaactgtcatcgcaaagcaaggcaatgaccccacactgcatttaggtagcatctggaaagaatccaaactaacattccatcataaatttgccttcagacatagcaaatgttcagattcggtgatgaaagtgcagaagctggctcaggggaattttctacgggccacattgtgctgtcatgtattttcatttgtggtaacttacaattacacagcattttacaaactatctctttgtcactgggcacaaatcttccagctcaccaaggggcttgttttactgcaggattcctagagattgagaaactgcagctgatattaacactaatcctgacctttctccaaattttaaatgatcgcagaacaaataacccgtcctggaaaatagttattttcctaggcagtagagacgattaaataaagataaatgggtaagtacggagaacgaaaataactaactgtataaattattttagtaaaaatgagtctgcctctctatagttagttgaaatgttttcggttggaaaggatttacttgattcgatttcctgaagatggctgggagatgttcaatacagaattgtacatttgaaagataaatctaagtgggctgaaacaatgtggcagcaactgctgtgatgtttggtctggtcttccctttagtactttcacttaagtaccaggtctatttttttaaggttttggctcttatgaatttctgcagtagtagttaatgtatgtatcggcatcccagacacgtatgcctgctaaagcctttgtttgtttttgtaccagaatcatacttttaagtaaattaccgttcatgtgcacaaaaccattgggtcagtgtatagatactgaatcactaatgtgaaactatgaccaaaacacatcctatatataaatgagaaattcctacccaggttaataaaagctatgtttacatgataccaatacagctgaacaacttttagtaaaaaattgagtcaaaacaggtcgtgtgagagaggtcacgctggccagctgctttggtatcatgtacacacgagcaaatagcggctatacagtctggttaccacacccacagggaagcatggtagacagaacccagccaccacacgccaaaacacagcacaacaatatggcatttactttaacaagcaaggaggaataatcaagaaggaagggcaattgggtcctcactctaggagatggtggctgaagacattttacacctgtttttaagtttcctataacagatctggaaaacgtcaaagggctggcagtctttcgaaaggcaagtttcagatactattgcaccacctattcaaatagcccgtaagttctgccaacagttaaggatgaaactgcttctcacaatagagatagagaaccttgggttctttctggatattggaacatatgcatggctcggcaaattgaaagtggtgctttctgaaaactgtttttagctgtttgagttctacttgtgttattttgaatactgccacacaagaactaaaaatctctgtcatttcttaaagagtttaaacaaacaatattaaaataccatcttccgtcacattgaaaggcagttggatatgtttttcctccatatttacatatacagagttctgatctagaaaaccaatacaataaaccattttatgttttaaaaacaggcagtctttggtgacgcaaaggcagagatatttttgttacctcctgcctatttcgctctgtctcataaagtgaatattattggcactgtcagaaagttctaaatactgctcaacagacaaaacaaaatacccatcgtaaccttgtacccgcccagtgctcaaaagctgctgcttttccccttctgtccatgccctaatcccctcttccccctcttgcagccttctttgttccttagtccaggcctgggccactgcgcgctgtctggcaatctccaacacgtgattcttttcctcttcgacagttgtcccataccggatgttgaagcacagggctccatgctggagctgaatatctgcaaaccgtctagtcctcccattcaacacagaagtcatctgggacacagtgacattgacaccattctccagaatccgcctccccccagtgttaccgatgagcaccaggtcttcctccagagacccaagcttaatgaagtagtgagtgtccctcccctctatggtaaaatgtaggttttccaggtaatgggcattattgagaatggcagcaagccgcctgctatcttcattggctactcctataatatcagctgttactatgccatccttgatggcaaattttatacctttcccaaaaacagaagggacagcagcaaaccttggttgcttccctccttcaaggcaccgtccatcattgtatcggggagtcataggtagttggtccaaggaaatgaaattcctgagctgtttctggagttcacactgaatgcccaggatagtctaggaaagagaggcacagagcagatgcagcatggagttagacatctgtcagatacttggtgattgtggaaaggacaggcttgcaagtttgcttccttctctctttaatttgtcagtgagtgatttaaaaataagccagatttggaatctcttcatcagagatttggaaaagactaacaggtgactacctagcattcttatatcttggtggagttaagcataaggaaatacatttaaacttgaaatcacagaattgcagagctggaaggcactttaagttggtccagctctcccaaaacacagacattttattttcactgatttcactcacactgactagatgttattactacatgtagagtaatacttaggcacagtgaggcacaaagaaatgcataaggcatagttcctactttaaagagtttaagaccttataattaactatggcaaatcagccagaaattcattgatctttttatgtggacttaaaaaaaacctttttttttgggcaattttcaaacatactaagaaataaagagaaaagactaatgaacctccaagtatccattatgaagcttcagcaattttcaacattttgctaaatgttttttagaaggacttttaattacagaaagcatttacatctttacaaaaagggatgaatttataggacctatctagaacttcctgtcccttataattttttagacttaaatttcaaggcctcacacccaaatttcagttttattctatcaagcccattttgttttcgcaaacacagatattcatatttctttcagttgaaagaaaaagctccttattttcatttgtacctcatacttctggtgatatcatctgctgaatcttaaatgttttgatgttcctattttttctcaaaactgtacccttgtaatatttattatttttgcttcattgtgtttatgtattttttctttatcagaataattttattctgttattcccatgctcttaagacatcaacccctaaattattttacagttggaaatctgatgttttcgtgtctcttaccgaacaattttctctaggtagaatccataattgctcttggtagcccatttcagaatttttaaagtacagttcctctttcctcttatgtacctattgcagcagtcatcaagtaacctgttaatcttttttttcccccaaaactccaattctctgatcttttttctcatggagctttttttataccttctcattaattgtgcacgttttagtgaatattcaagaagactaaaaaatcagtaagcaaacatatgtatatataatttctgggtattgaatgcccttctgttgtttcagctaaaaggaggtgataaaacttttactaacctttccaggatcccactcttgagtttttgtctgaagccgtagaagctcgtaagttaattctaaattttctaattcaggtttgggaaatccaggtagtacattgtgtaattggaaaccaaatagctccaaccaacttctgatgtctgtgagacacaatattaaaaaaagaaaatgaaaaatcccatactttataagctttgttgaaaacttgaaagatacctctcctgccttcaaactgtttaggcaatagaagttaggaataaaactcctatttatttatttatttatttatttatttatttatttgacatagtctcactctgttgcccaggctggagtacagtggtgcaatcttggctcactgcaacctccacctcttgggttcaagcgattctcctgcctcagcctccttcctgagtagctgggattataggcatgtgctaatttttgtatttttagtagagatggggtttcaccatgttggccaggctggtctcaaactcctggcctcaagtgatctgcctgcctcagcctcccaatgctgggattacaggtgtgagccaccgcacccagcctaaaactcccctttatatggcccacactaaaacacctgatcctctctctacagggtagagtgttgatttgtggataaccctggattataatatcagcttatatgatgaaacaagaatcctgaatttttcttttacgaaattattcatataagcttgtaagagtaaaacacagaaacagctaaaaaatgtagtaggatgcaaaagtattatatgttaacatgcacgttttgctcactctagaaaactaaggaagacagcaaatgcacaataacttgcgggctaactgtcaggaagaggaagcatatttacaaaggcattgagattctgtgataaaatcaacagtactgagttactcaagtttagcttaaagttttaaatagtttaaatacctgtggtatactttgcaacatcttgaattttgccaactgggtagttattttcaaaggagtagaggttgaatggtttaggaaggaggttcaactgtttccatatgtgatgattaggcgttgtccatctgccagcaacaacatcataatccctttgccccaggtgcactaatttagtaaggaaatcatagagtcctccatgaaaaccaataatgacctgaaagtcagggtaagtgtcatgatagatatcgccataaggtgtgtatagtatctcctttatgacctgacctcggctgctgaacacagctagtggggtacctgtattatcacaggctacataatattcttcaccactgcttaactccatggcaataaggtgaccttggagatcataatacagagatgtaatctccgagcttgtgtggttgtacaaatgagtaactcttatggggttggtaaggtctgcataaaagaactgaaggtgctgccctaggctggacttactcgcgacacgtcgcccaagcccatcatagtaatactgcacagtccagccagaagccttattgtaggctttctgcagcaggccattagaattatattcaaaaatatcatttcccctctgcctcagaaagccatcttcatccattttatactgaatttctcctaatctggtgatgcggtctcggaggtcatatcggagaggagtaagacgagcactcttcccatggcttaagaggttgatgtttccattcagatcgtaactataacgccactgggttttgtcatttacagaaacagtctgaagttgcccatcagcatcgtattcatagaagtaccttgttatattggcatctactcctacccttatgtcacatattaccatgcggcccacattatcatattgaatggtcatccagtaggcaattgcctttaggatttcatattggacttcaatgacttgtccattggcactgaagattttggtgtgtttcatcactgtagtagttatgacctgatttaaatcgtaattaattacactgaattttccaaactgctctgttctgccagagacatcaacatatcggtaaagatctataggcaaaggggtttcattgattacagcttgcatgcttgtgactcggaaattgttgtagctgtagtcgaaccgtgcattcacaaggccttcttcactgaatctgaaaatctggcgtccaataagaggtcctgcaggaaccaaaacaaaaacagtaagaagctaggcgatcaatgtggaagagtcagaaaggtctagtgttattttatttagtactggtgcttttatattcataatacaatattagagactgatctctgatatcaaatgcctgggcatattacctcatggatatatattctcatagtggtaatcctcaaatataaaaaattaaaatactctatagttatagaaaattttaattatagaaactacagaagtaataacacatccagtagcccagggtgatgaaattgatacttcttgctataatcactgacaaaaatgctttcatttcatttaacctttgctacaaagtcagagggtcaggttttgacaaattccagcattaaagtaactggatttgggcattctataaacccaaagggtgaaatacattagaaagttctgacttgtgaagatattttgtcatcaactgaggcttataaaggttacacagggcttgagctagtttcagtgagacttatatcttgccgtttcatctttgagaagatttggtgctgagcaggaatgggtatacagttacactaggcacttggatttcaaattacttgagagctgaaagaaagaaatgcactatatgtttttaagaaatcagctttcatcagactataacatgctttacattttcaatgtcagataatttgataagtaaagtgaaagttgggttgaatgtgtgtagattaatgcttctatctcacactgtggtcagtaaaaatgtcataagaaaatagtgatgttgttgtacacaccaccactctttcacaacaaacctgtttgcctgtatctgattgtgcagatgaatccgtcatgcatcaggtgtattgtcttaatcactccagaagactcttcatatgttaatgtgacctgagtggtatcatagagaacctcagaaagccttgcttgcttggtgtacttgtataagactctgcgccctgtccccagatgcagggtctgtagcaatcggccatctcgactatagtcttggataaaagaagtgctactgtccggtggggtgtagatgttccggtagtagcccactgaaagcatggtttgtaagctgtgacgcaccatgctaggcatggtgactgagagcagacaatctggttggtcatactcaaagatgtaacgccgctggctgtgtaggagaagcatcacagactgaaacgagacaaaggcagaatagcatattatggacaactaaagttgaggcgactaaagaaaatacacattcatccattcaacacaaatcaatcaagcacttactgtgtgccagacactgtggcaaaccctagtggatacagtagtgcacaatagtggtgtctatcttcatgaaatttacagttttaatggaggagaaagacaagtaaccaagcaattacaatatagtgtgaaatgtgttatgacaggggagttacagagtgcttctggaaggcagaggaagaccagcttactcagacttgagagaccagaaaaggcttcttggataaagtggcatctgagttgagacataaagattgcctagggattgtccaggtgaaggcagggagccgggggcaggggtagggaaagagtattcttggcagagagcacagccttgtgagggtctggatatgaaaaagaacacggctttttcagagaatgagagaaattttgtgtggctagaacttgagtatgttgggagtggtgggaatggcaggagatgacgtcagctatgtaggctgagtccagatcatgctaggctttctaagccacactaaggagtttggattcaagtatgttggcaacagggagtcatcgaagggtttctattttatttcatttttttagagccagggtctcacggtgttgcccaggctggagtgcagtggtgtagtcatagctcactgcagcctcgaactcctgagcttaggctatcctcctgtctcagcctcctgagtaactgggactaccaatgtgtgccactgcatctggcactcttgaagggttttaagcaagttaagggacggttgcaagagggcacttgcaagctgggagaaactgtcaagttggtattttagaaaggttacttcaacgtgcatatgtttcagaggaaggtaaatggatggcagggcatttcacaaattaatttatagttatcataaagtattgattgacttcacatactagatgtcttcctaaaaattgtgcataaaatattattatggcactattaatgttttgcaattgatgttttaacttcacatttccatttgtgttttaatattagggaagcatgtcattaaaactgaatgattctctggttatgcagcccctctcccccaaactgatctgtattttagaaacagttgtttgttgaggtataatgcaggtaacaggtgtttcataaatattgattgtcttgttttaattctaaatgcagacataaaaggagcactgttttagggaggactctaattgactgacatgtgcatctcatcttttaataaaaataaaaatttctcatccttggagattctgatatgactccctagaggagctttatccttcccctttagaaaattaccttttcaagcaaagagatttagttgagggttatttattcaagtttgtgttatgaaaacaataggtatattttcattttctaagcacaaattatataaatatttatgaatgtgaattacacaagtatatgtaatgtacatttatatcttctaaatatgacattacattctaatattgaatgtgctttctgaaactgcatatcctccctacccttctgagaattattgactttgaattgcatttcagtaccatgaagtcaaagtcagtggttatttgctcatttgttcattctttcttttccaccaacattacgcctgcagagccagaggtgagtgcagaaatcctgtcaattcgtcacttgtggacaacctgcagcttgccacagcctacagttccaccactgtgacctctgaaaacctcctgaacaaaaggaaggagacttggaaatcctgaatgggcttggagacattaagggagaactgcctccctggaccaaggcagaattcaatagaaccagcaagaaattttcctatgaatgggaaagcaggtggcagggggcaggggtggaaaagctttgtacaggaattgtggaaaagcttttgcattatctctagtctgaaagtcacatttctcagttcctttccactctcttctgtcaacttgctgtgagtaaatgacatctgtcacctgtgacacgggccagggactatcaccatatggcccccacacattatctagtaccagcctgcctgggccatgccttttccagtcactgtaccagcctttccaagtatttatggcacgtcgttgttattctctcctctgttcccatcctcctgcctgcagtaaaccactgcctgaaccgtgttcctaggtggtgctgatgctgggctgtctcaaaagcccttagtctgtttcaaagcttcctgccaatggcaagaatgtggatgatgtgattagaaatcaaatgaatgtaactgttacattgccaaaataccatttagctctcatttggctgctttttcactttgggtgggcattattatcagtttgctcaaaaacagtgcttatgaatctatccaatgtccacaatgctgttataggataaaaggccatttcttattagtccaaataacagagtgggagacttttattcttttaattgattgtgaggttctaaaagagataattgtaaaagcaacaacaacagcaacagcaatcatggctgtatgcttatttgaacaagactagaaatgagagcagaaatttgaaaagttaaagcatttgaatgaccaccagatggcagtgtggggccacctggaagctgaagccaaagtcgtcgttctgtctctctaggcagcctctgaaagtgtcagccccaaagaggcaattgctgtaaatgtataaggctaaagtatcttattaaatgattataaaatatatttaaatgcattttaaaaatgaagttcataagaattattttaggaaactgaaaggtttacatttactctaatacaaaattttagcccacaagtcttcaaaatataattaactcagagaagtctcataaatcaagacagagaattaatgaccacatagagaaaatttaagaaacaataattgatttttttaatagggaagagatcattaagcaaccacagccattacccaaataattatttttctcctaatggctacaaccattgtgcatgaaaatgatatgcataagtttcacttactctagaagaagtcaaactattttcacaaaatttctgcgtgttaaggtgaaaaatctgctgctgctttttaatacatcgtgacacaggtatggcaagcgaattcacaaggtaataccagagtattttggggtgtaaaaagagaaatccattttaaagtttgagaattcttagtttaaaatatactacaagaacgagcctctttatccctgctctgcccctgtcatagtgggagaatgtgccacaaaggccatattaatgagaggactggaaagaacacaaggagatacaaaacctcaagtcagtgaaaaagttacatgttacatgggattttggtaaattcaatgttctttccctttttccctctagaatcacaatttcaaagatgctttaatttcctccctccctccctgcctccctcccttccttccttcttccctcccttactttcttctgctctttcttgttttgatttacctccaagtggcagtaagtgctagctagcatttaaattctctacttgggtgttttatattaagttatttcatttaattatatctattcagtgaattagttatgattactggtaataataatgttaataaaatcaattttatgacaaatgacttttggaaagtaaagaatcgttccataattatgcgttctgtaggttctgagttttgcataacaggactgcttaaatcagtagctacccttttaattagagaacaaattaaatataaaatcaagaaaggaacaaaagtgaactcaaaggtacaaataagctggtttgtctcactggtcagaaagttaccaggacttgtcttgataccttattctgggtgaggaaggtcttatttttgtccactgcagacactggcagtctcaccgaggtttttgtttgtttgcttagcaattattgccaactacgtttttgtagcaaagagaacttgtgaagtttgcttcacgtgattctttgcttaagtaaatttgatggaataatcagtgaattcggaaaagagaaacaataaaatctcctcattggtgtcagagaagaggctaaataactgcacccagggatgaaattgaagttttcaataggctcttatgttattgtgcagatagtctaaagggaaagtcttttttttattattatactttaagttttagggtacatgtgcacaatgtgcaggttagttacgtatgtatacatgtgccatgctggtgcgctgcacccactaactcgtcatctagaggggaaagtcttatgagacctagatgtgactgtctataggcaattagctcagttggtcggactctggtgccaatgaggttggaattatgagtgcaatcctacgtatgcttctaaggagtgctggctacttaactagtcacatgggggacctgtggaaagattggtgcaaacctgtcttcctttctgaaaaactaactcagctaatattctgttagtgatcagtagcactgtttttttcatatgaaggtcatcaatatacaccttaagaaatactttgcctatgcacacataccagcaaatttttggattcagttaatgttgtaacaggcttggcattctgtaggcactagtcacacggttttgccaatcattcttgttaccaaaattcaaaagaggaaagacctgctctataagattcagattttgccagtgtagaggatagattatagatttgataaatatttctagcaaaaaaggacatgaggtggattcaccaaaggactccttccttttgccctggctcccaagtgaactctgcttcatctccaggcatttccaacttggtaaattctccagcaacaaactctgggaactagtaacatggtttgataatgacatataaccactggcacactatttttgtttaactttggggagggcgtatcagaaaagttgggcattatttggtaccaatagggaaatctgtcatgtgagctatgagctcctatgacttctctaagaacatctagaagctaccttgtactgattacccttgaattctcaagggaagccatttttcaatttttgtagaaattaatttaggactgatgaattcctaaatgtgttgaaagaatagatttgggaaacaagaggcactatcttaggagattagacattgagatagagatcaattactcttactgtcctctggtaccaatctggccagaaaccattttgctctgtaggggctgatgtttgacaaatggttcctgtagtgggattaaaatatttttctattattcccagacacaggccacaagctcccattatggatgctactggagactcagtgtacagaaaagagtattaccaatgaggccccactaccaccattcccgcaggctgattacttttggaaattagtcttcaaatgtatacaactaaaacttcactgactatcctaacaaaattagaattgcttatcctctgggtaaaaagccctttaccagagctgagtacattaacacaattttataattttctagctatttttccctcggtatgagctttcataataataaagataaccttttcaaaagcatgaacaaagatgttcaaatgaggagaaagctaagccgttattctgactttagtctgaaagagtacttggcagagtctgggactggggaaaattttcagctgaaaaacagtttatccttataagttcaacatctttttgttacttctacagaacagaacagctggaacacagacttttctcctgcaggtcctcaccaagatggacaattagggccattttcgatagtctcattcagaaacttgaaacttgtctttttcccctatgtacttactttttctaagtaggtatagctccaaattttcccatcagcccaagttcttgaaataattttcccactctggtcatattccattttttcattccacgttcctctttgaataaacgtcaccaatcccgaaggtgaatatgtgatgttcacttcattatatctgcttacaggagaccacagaatgggtcgcccagtctggtcataaagaattcgaagggtgaattttcgatggtcatcatagatctttcctgtgcgggttatatgatcaaaatctatggagagtaggtttctgttgtgggcctatgagaaagagatatgaaatacattttaagcacagccttgttcccctcattagagcactgacaatcatgaatcctttcctgattatccaacgatagagtctgtcttgcctctgaagcctcacggcttcacattccacagatgccacctgtctttattcctctaccacattgtacactctcagagagcagggctatgtcttaagtacttgaaatactctagactctcaataggtggttgttgattgctttttccccagctcaagccttaagtgcagtgccacagttttcagtaattatgtgatcttattttatgtaagtcagttgcctactaaggagtgggtattccttcacccttttcaccagtgaagtggccataacataaaagggtgaattatttgtgtgattagaaatcagacaaaaggaatacagtgagccccctctaacttatacagattcccttctttggtttcctcattcacctgggcttggagttttatatgatttcacacctattataggggaactcaggttgccttgccctctagttatggaatctcacttagcaatactttcacggaggcctgtaggtaaatgaactaagtgttggtaggtcccccagcattcacaagggcagcaccactaactgtggttaaagcacagagttaagtttggattccaagtttagaaacagtactttcacatgattctggttctagactttttctaccgtatggtagcattttctctgggcacctcaaaaccttgtagcagtcccagagtgatcctgattcaagggatcttgaactggattccatgaaagacagtattcaacggtgcctgactgataaaattcatctgggttcacacaagataaccaaataactaaatgacttagtaaaaaaaaaaaaagtttaaaaaatcagcagtgggacaactgacctgattttttccacgtttcagctggtagtgtcagtgtttgctagatctaccagtaacttctgctatgggtagctgattacaacacaatcacttagaaaatgcaatcctcaactgtttttttttgtgtgtgtgtgtttcagaaaaaaaaaaggtgttcttgattttagtcattaagaggttcagtccctgctggccagtgcactgaagaaggccctgtggaagaggggagctttgaagaaggcataggtggaaagtgcaggaaggaattttaaaatttattttattttagcttagctcagtttagttaagttttagttttagtgggttttatgttttgttgtgttaaaactttttatttttacatagtctgactcacaagaagttgcaaaaatggtagagttgctgtgtacccttcacccagcttttaggggacagacttctgatttgggtggagagagtcctagtgtatccggcaggaacaaaaacaagaatgaaaaaggagagactttgaggagtctaagtagcagtgaactgcagtcaggagacattcaaactagttacttgtctgtgcaccagtcatttcttccatctgcgccttagttttcttatctgtgaaacaagagtgatgttaccactttacaccacaaacttgtgctaagaattaaacgatattccatatacaggtacttggtaagctgtgaaacaacactagtaattgttatttgtataacataatgattacttttctcattttatttaggcttgtgaataggaccacatttcagattccaaggtgattgtagcttagtgtactagatttatatcggtaagagttgtcaacatgatcctgaatgaaatgttaaatatcttgttaatgaaggggaggagtgaaactcacattaggatttgactacattaatcatagtcagattaaactgattcactagctactcaactaaacttgatgttaattttaacttttgtggtcaaggatctgtttaactatctgaaagctatgcaatgtatcccaagaaaagtgcatataaaatgcatatatattaacatttttaatatactcttaggggggctttgaacctttctgaaaaacctaaacataaaaccttttcaggtctcaggaatccaagatcaacatcctggttcagaaagagttttgatcttagaggtctggatggctgcaaagctaatgctctcataccagactctggtcttcctttgttcagaatcttgtgctctttgctttaaaaagtaacctttccctcccacccccaaatataaaagagataactttttcatggcagaaaaattagaaatatagaaatgtacaaaggatataattacatgtaatccaaccatccaatgaaaatcactgttaacacttcactgtatttcatttcatttatcttacttttttggcataatctctgtgcatacatttaaaacatacaactaggattgtatttaaagttttgtgtcctactttttcagctaatgttttatctttagcattccttgtgttattcaatgttcttaaaatatactttttaatggttgcatgtcttactacatgataaacatttatttatctattctcccaattagaaatcagaaagtagtttttgtttttctctttcatattgcatgttttgctgaacatttttataagtaaatatttccataatacagaaccctatgagtgaaattactgggtcaaatgagacatgttaaaagacccctgatgcaacctgagagattactttatagtgcacagaggttgtataaattcatactcccattagctagtagtgggagaggctatctcagtccatccttactagcattgagtattatcagttaattaacttttcccaatatgagagtgggaaaatgatatgctgctgtggcttaaatttgcatttatttgattactactgaggctgaacactttttaacatctattggccacatgtgtatcttctataaattgtctgctcatgatatttgcccatttttctattggggtgtgacactttcctttttaaacctcttttggtttcagtttcttcattggtcagctggggctaatgttatttgcccttaattttgaacttctgaaaaaaaaaaaaagaagacctaccaaatgttccatgccatgaattgtatctggaagactagtggttagatgcttaaattatctgggggcaagtgccgtttgtgtcaggggtaggtttaattcagggagtacaaccacaaattgggactcttgactctttataccatctgtggccaatgcatgcagtgttgtcttgcatacatatacagccacctgttgttatgtgcttatgtgttgttatgtgcacctaaaaggtgataagaaaagcgcatatttcctgtcttttgatacaacgggcctggaagcctataggaaaccaggtgttcttgaactacccttcctgtggtttcacagccacatatctccaactgtaatactgttcatttacaatagctgtaaaatatccatgtactcccagagatggttgtaactgttgcaatttatgctataatgatagttaaagagccaaagtaacaagtgatttccagttcaactaaatttgtggttttatttgtctgatagattaagtttactactcaagaacacatttcttagtaaagtcattatagctacataagcagggatcactgtttaaaatccaccacaaagcaagcagaggacaactctgcctaatgttctttctctgcctgtcaagacgtctgccgctgtgcttctctgtttatggataatgcactctgatattccagtgctgctgaaacactagtttcaaagtcaggtttggaagttaatgtaaaattcggctaagagctaaaaaagaatgaaggaactgaagatgccacaggttcctccctgagtctcctggggaaaccatgtgtgagaagcctggcaaagagaatgcttttccagctgagcctctcccaaccttttttttttttttcgagccggagttttgctcttgtcacccaggctggagtgcaatggcacgatcttggctcactgcaacctccacttcctggttcaagcgattctcctgcctcagcctcccgagtagctgggattacaggtgcccgccaccacgcccagctaatttttttgtatttttagtagagacagggtttcgccatgttggccaggctggtctcgaactcctgacctcaggcaatccacccacctcaccctcccaaagtgctgggattacaggcatgagccaccacgccaggcctccaacctccttcttgagtgctcacgtgccaccagcctctatgataagaataagaactaggctgaacactacctactactgggtttgtgggcaaggctgagaaagctccacattcatacaagtgcttgctttcctgaaagatgatagcccttgacctaagtgtggaccatcaatctttatttccactcttgtttcagtattcaatctacactaatcctttccctggaaaagagaagggggggaaaaaaggattgaaatttgggaatagctccaagttaaaaagggtatctttggatagctgtgcattgaataaaacctttgagtttggcaactgacaggctgtgtggtgtggtaagaaaactgtttggtaataggtttttaataagggaagatggatctacgctgtaatgcatccttcggtttcccttatgtttttttcagctatactaggagacaggcctgattgttgttcatactaggaccagagaggaaagagggaagagtgtgctctggagagccacgaatagtgttgctggcagaaatgaaaaggcctgtaaaaagagggtatatggggaaaagcaaagccctttcctgctctttctgaggactttgtgttctaattgttcaagagaaaatcctttcaacccttctgatttgaaagtcgttcagttagaaaaataacattgtactacgttgatctaaaggcaattggtgatatttagctgtttttgacctacacaaagggcaatttgctatggttcaaccaactacacacttgcacacccacgcctgtgaatgtgctgaactctgagctatgatcactgcagttgattttctcccctccttaaggaggagaaggctgaattttcaagaacactgtcactagacaactgtgttacttgtttaatttttgctgaagaagttggaaggtaaataagtgagatgggccaaatagccacgtcagagtttggaagatcctgcatttaatttttttgtttttgtttttgtttttgagacagagtctcgctctgtcgcccaggctggagtgcaatggcatgatcttggctcaccacaacctccacctcccgggttcaagggattctcctgcctcagcctcctgagtagctgggattataggcacccgccaccatgcccggttaatttttgtatttttagtagagacggggtttcaccatgttggccagcctggtcttgaagtgacccagtgatccacccgcctcagcctcccaaagtcctgggattacaggtgtgagccaccgtgcccggcctcctgcatttaatttttatgaagttgtgagaatggatagaaaagtcacagttggggctgggcgcggtggctcacgtctgtaatcccagcactttgggaggcccaggcgggcggatcacaaggtcaggagatagagaccatcctggctaatgcggtgaaaccccatctctattaaaaatacaaaaaattagccgggcgtggtggcaggcgcctgtaatcccagctactcggaaggctgaggaaggagaactgctcgaacagaggagacggagcttgcagtgggccaagatcgcgccactgccctccagcctgggcgacagagcaagactcttaaaaaaaaaaaaaagtcacagttgatcttaaaaagtaccacatgctactttactctcactagttttaaggtaattagtatttgatttttagaaatcaatcactacattaattccacagatttttttttttattggtatctcttggtagacaatcaaaagcttacttaagcctacttttatttcacagagatgcctaccaatgaacagggcatatgttcagtactagcatcagcctctaatatttcacctggaattcccatttttttctttctttttgaaagagaactaaacttacttttaaaatagatggaataaatgtataatttctctagacattttattctttaaaaattatttcatatttaacaagaatcattgtatgacatttatgcaggattttctttttttctttttttttattttttggtgtatatgtgctttattattttaaaatcaactttatttggatagtttacacacagtaggagtcaccaattttaagcgtacaatttaatgagttttgacagtcattgaatcaggtaaccactaccacaatcgtgatagcatttccatcacccccaaaacttctcatttccctttacgtcaatttaacatccccaccaactgttttgtcccccatgcaggattttcaatcatttgtttacatagtgatagatttctagaaaagtttacatgacatcataataacctttgacacaaaactgcttgagttagaaggaacccttctgttcactcttatccgactacccactgtaatttacaatcacatacaactagttgtttctaattcttttgaagaatttgattcaataatataatgttttttactcccaagacactccctttactttgccagcatatagaaccttatcaacagaggggatcttaggaaatgggcttttgagccagactgcctgaattcaaatcctgtgatcactgcttactagctgtgtgacctctctgtgcctcagtttcttcatctgtaaaatgggaatgataatgataaacccatctggtaaggtgttataaatagtaaatgagttaatatgtggcagtatacatggtaaggcttcaaggaatgctaattgctgctgttatggttaatactaccactaataatatattgcaccatccatgtccctctttttatagatgagaaaagtgcaaaattatgggcataccagttcttcctcaaaatcatactcatttttctcacccaactttggctatattatttaccttggacattttttgcactatgctaatttgcccttgcttaagtactttgctgttgaccaattcatctgtgtaaccatacaacagatatttaaaatttttttataccaaatcattaatgctcatatacaggtgaaatggtatatgaaataattctttctttctagttatcttagtgaggttgatccaagattaacaaaaataggctaggcacggtgactcgtgcctgaagtcccagcactttaggaggctgaggtgggcggatggcttgagtccaggagttcaagaccagcctgggcaacatggcaagaccctgtctttacaaagaaacaaaaacaaaaattagccgagcacggtggcatgcgcctgtagtcccagctactcaggagactgaggtgggagattcgcttgagcccgggagttagaggctgcagtgagccaagatcgtgccactgcattccactctgggagacaaaaaacaaaaaaacaaaaacacaaccaaatatagcaggttctatgatttggaagccccaagaattcctggaccccaaaaatcaatactgcccagtagccttgatataggaaatctcctgtctccagggggctccttagggggaaaagcactgttacttgactgaaaactgcagatatatttttaaatagattaatctgattaatatatctccagtcaggctccttatctaaattttcacaaaataaatgcttccaccaaacctgaggagaaggaagttaaaatagtgtcaagtgaatgaaaatccaactctgagcaccctgtagctgaggaccaaggcaatttctcagaatagagggaaaggccagagccctcttggctgcccccaccaattccccatcatttgtcagcctgagaccctgtgttcaaccgagcttgtttctccttctcagctcacatctgaacactcacgtttcatttaaaaaccaacctaccctattctcagttatgtttgagtagaggaaaaaagtaaattgggagagttttagataagtccttgcttcatttcatttgtaaacacataataatcctacctgattttataattttggtcataaagtgctaagccccctccattgtttttcttttaataaaggaggctgcagttcagggattttgctataaccttacaactcagtctacaaaatcttataaacagctctgggatccaaagctgggatacatctcatatgacagcattgttatccatggacatagcaaggtacaaactggatgtagttcctaaaccagtatgcttttggtaaatgcccaattctttttacaattgcctctattgttatctgcactctaatttctctattgtccagggaaatgtatttatggggacagattgatgcagcagataagcagatacatggactagatgcaaaagtgccttgcaaggaaggaagatgagtcaaacacaactcaggttggagggaaatggattttttaaataaatgaaatttcaggatgttaatgtgacttatttcacttaatggagctggtgaaggatggctcagaggtaacaaatcccttgcctgctcaggctgagcagggtatcatgtttcccaaaagtttgcctccctcaccttaaaaaggatcctgacgttgcatgaaaaaaaatcactgattattctccaaagataggtctatccttttctgatttttttttctttccagctaaaaggtctgggggaggtgtgatcggcagcttttgggaacatttgacgtctatcatcttaccaaatgggcctttaaatgaacctgtcattttgtccttgaacaattagtgctttatggcctgcacacttgcaaattacaaccacacttttgtgtgggttttcaaaagggagccccatttcccacagtacagaaggggtttctatgttgtatgacttggaaattctgtctcaacagctctgatagctccacctgccctcagtctgaaatgacagcttcactagaagaaataaatgattcagtccaaggtattgaggaacttgagagcatcagagaagcttattctttggatgcttacaaatgggtcattgcatattttggtccaggaagagagaaaattggcatcagcttgtcccttgaaagctaccagaaatgaagggacgccatctcggaaataataacgtcagtgggggaagagaatttgctttgtcaaaattggattcacatgtcccttttgggagcatactcatttcattaaattggaaatgccaaatctggggaaattgaggcatcagcataaaaaaaatcactaggaatagggagatcgggtaaaaattaaccagttaagcagcctccttcctctttttgcctgcttcatgcttttcctgcctggaagccagccagttgtcctgtgcctcccacacttgccagtacattagagtcgattatttgtccctttttgtcagcattgaaatgaggagtcaggccctgccaaggtagctccactgagtggggcaatgatttatagattaattattttaaggaacaaggcagcacagtgtgatgcagtagaaagagtgccatgctaggtgaggacctgcattttagctctggctctgatccttaatagctggttgactttgggcaaatcacttaacctacctgggccttggtctccttatctgtaaattgaaagtaacaattgacagctgtggtgatcaaataaaatcctggctatgaaaccattttgttcactctgaggcactaaacatatgtaaatgattgttattgttattagacttctggggcatgccatggtaacaccacctggccaataaggggcctcatttttcagtcacaggacctcagggagtagcctagaagtgatatagagaagagggccttgaatttgttgcccttatagtccagtccgcaaatctgctcaactctgccacaggatcggaaatgggtcacattataattagtactaactaaacactttacttcttaacactaatgagctcccaaatgttttatgacaattagcttctcagcactaagaacaatttgggatatggggtgtaaattacagtttatagtttctctccattatctgtgcatatggaggacagaaaacaggatgggttgttctagaaaatggaaacttccaaggtcacataatataggatgagttatcctaaagaatgaaaaatcccaaagtcacatagtatatgatttggttcagaaagtttttttgaggctatatgctgggagaggtactaagaaatcatgtcttcaatacaatttttctgtgatgagtccatgaggtcgataagccatatgtagataattcttactttctctagtagtacacttttattttacaggtgaaaaaaaaaaatcaaggcatttcttaaagcgtttgtaaaatagggtatcaaggccaggttctctaacttccccatccagggttctacccaggaggtcctatttctcaaagaattccgatagaaatctttactgctacccacacattggtttgatatttggattggtttcacttctccattcagtggcatatctggtaaatattctgtcagaaacttgtcaatagaatcgaaacataaaaattgacttgtgcacatacaaatttcagtagctttataaaaaaaaaacccaaacaaaaccaaacaacaacaaaaaaaccacccactaaagtctgtggctgtgtgtcaccaagagaactgattgaaaagtgagcactggccgggcacggtggctcatgcctgtaatcccagcactttgggaggccgaggcaggtggatcacgaggtcaggagatcaagaccatcctggcgaacacggtgaaatcccgtctctactaaaaatacaaaaaagtagccgggtgtggtggcgggcacctgtagtcccagctacttgggaggctgaggcaggagaatggcgtgaacccgggaggcagagcttgcagtgagccgagatcgcaccactgcactccagcctgggcgacagagcaagactcttgtctcaaaaaaaaaaaaagaaaaaaaaaagaaaagtgagcactgctgtagattattttgttcatatcaagccatatgaccggtttgactgcctctctctggaattgggtggttgtttgggggttgcacttccacaaccttaaggttaccaaatttttgatatgagttctacatttcttttcaaataattaatatgtcagtatgttcaattctttgccttctacttttaaacttaacttcctcgtaaagcaacctttttcaattacctactccaccctgactcattccgattacctgctccaccctaaatcattcggatcacctgctctaccctaactcattcagattacctgctacctgctctgccctgactcccgccaaaacactcaccccgtcattctctttaaattagccaatcggaattagtttagtctgtgcggtctaaccctagccaataggggaacgacacagcaacacgtgcgtcagggataagagccccttcccctcccttgtccaagtgtgcactcaccattgctccatctgtaagggcgcacccttctatagaagtaacttgccttactgataattaaaaagaaaattttatattcgagtgctattccttttgcggcaccgaaactttatatataacagaaaccttcccggtatatcaggcgtgacacaggtgctcaaagcagatctggcctcaatagtgagtgattatttcccgcaggctggcagttgctctagggctgatattgaatgttactacatgtagaaagctggccacatcatcctaacactggttaacgttcaagaggaggcaggtagacagagtgctatggcgattgtaggctttgtgtgctgcagaaaagctgaccgaggtctcctggttaactctggtgaactgtgcttggtaaggactttaaaactccctaatctataacttcctccaggcagctctgagtacctcagcccaatctcagtaccagtcctttatccctctggccctggatatgtattcatggcaatgctataattcactgatttttcctcttgtctttgcccaaatgttgccttttgtctcacatccttttgtgtgtacctgcgaggtctttccaaagagctacctggaaagcagggacctcggtcaactcagtgaacctgatagacatctccagggcatgctgggaggggtgctggagggcctcctttgactaaacacatttctccagccagactttcttggtgaaattgctactattagagcactttagctggctaatgacaaagaaagctcctattagaatgctcatttaaggatactgaaccattatcggccattagcatcctcttttgaattagtatatcatataagccagtcagtcacttagaaaagctttggagaaatgggacttcagtttagggaggctctgcagttaaacaaacaaacaaacaaacaaacaaacaaacaaaacacctataaaagttctatatcttgtgtaaagtcaagccttaccctcagcctcctttcaaaagccgaaacattgcctttgttttgctccttcctctgccgccactcgatgaggtttgcattgtgctctccgggcaatgagatgttgcatttgcccagggtagggttgactgcccctgccaggatgtggggctctgagctgaggccgatctccatcccgctggcaaaagtgacacgcagggaaccatctggattcacccgataggtactttgagtattttctgtagacagaagagcaaaggaggaagagggggaaggaagggaagagcaggaagcagaaaagagacaggtttagttttaggaggcacgtttgggggataagcaggtggggtgctgtggtcctatctgccttctgggctagactaccgctctgacaggcaaacgtgttccctatccatttgggtcttgttattttcacagctggagtatctgtttcttggataaaagactcttgtctaacactgcaggctgtttttgtttttttcttttttcatttttaaagaattccctccctcactgacttgttggatcagcctcctcagtttgatatgctgggagctagaatgagaagagtgtgaagttcaacgtagcaccttaccacctgggcccaccatcacagttgccgtactccacaaaataccactaacaaaagttagtgtactcttagagtgtctggtgtcaccacctaacaacagaatgaggtcttaatgacagggcagagagaaagcaatttctctttgtgcacttgtcctctagcttctaagacattccaaatcctatctcccttccttcctttcttcttctgttcttccttacttttctgtcttcaaatataatgagtttttaattctctcatttcacttatattcttgcttggtctgtatcctaagattttcctttttcttcacccatgttggcattgatctagaatgccaagctcagctggagcccaggctccatttatttaatataacctagccagaccctgaaagacctttgcaaacagctgggtattgggaaataagttgatagcagagcagacttggcagggattgaacctcatgactcccacagagatgggcccaaagttgatgtgagaacttgtaaaaggtgtgaattttgtctgtgtttcaacttccatagctggaaaacaggaagagtacatcttctcagctagaggtgaattctgtttatgaatggtgtacgcaggtttcaaggtggatgttgacataggggctgttacagtcagatatcgttggaaacaatcttaccttgttttaaaatatatatggtactagttgccgtcaagttggttgacatgaggacattttcacggttggaagtatctagctccacttttgtcagcttctccaggtcactgtggaagctgctgacctctccagtgggaaacgttgcattggtcaggtgtccctcggggtcatacctgaggaatgtaaccaatcccagctttgaagcgtctcggcagtgataacaggactttgcaaaataaaaatcacttggcagctaatacagtttaactttgagtgataacaagtattattaaccttgttcaagaagaagaaaaaggtcagagagatgattaatcaaacgaaggtattttttgcagcttctgaattcttgataacttccttgagctgtgctgttttacagaaaaaatatatctggtaatgaatcaccagggtggaacactgatttatgaatcatgtcctgctgtgtgcaacgttgcagggaggcctccgtttgcgatttgggtcgatcccattagaggtgatggattacaaaacccagcagagggtgctgttgtcaaagcaaaagaaggtacaaaagggccctcaaaggctgagaagccaatatactgactttgggttatgatgggaaaattataatttgctgctgtttaagttgccaaatttgaaatgaatgaatcattcttccaacaaaatgaacaggcacagaggataatggaaacatgttcattaaaacattctggagccctctgatcttgatgtcacttaaattttaaaaatctttttagggtatagtacataaggttttgtaatttgtctatatgagtaagagacaaaaaataattacctgggataataggctataagctatatctagaaatatagtctagggagtttactttttccaaaaaaaaaaaaaaaaaaatcagaattattggcaatctcactgtcctccaaatgaaaactgcttccctgaaggcttttgatgtggagctgttcttttattgccaatagaaccatgaaaaataaacacttcattaaaagtaaacacatgtacttggaaacccattactgttttcttttcaagttgcaaattacaaaatatttaagcacttttatttgccttttaaaatgttaaacaattatattctttttacccaaaatgagcaggattcagcctggacacaatggtagagactggctgtactactccctcccccaacgattacacaaagtggcatagtaattcagtatcaatccattatattctaaaaaactcagcctgggtagttgctcaaattttaataactataccagcctttggaaggcttgggaaaagcagttggactgtactttataggacagacttgaacttgagcctatacataatgccacctaaagttcagttctgcatatacacgtgcgtgtgtgcacacacacatatatattatcagttaaaacagtcacatatgtgaatagaatgaatcaaataggttattgacatcacagatatgcctagccttagatgttaaattgggtgtctcctttgtttaaatggatttcagtcgaaatggttggcacagtgctattatgcagctaaggacgcgttatcaaagaaagactgaagagtgctgtttcttcctggggttaatggcaaaatccttccctctgcaaagactgcccacgttctgcctgctgtggggctctatagctacaagaagcagaagaacggagcataggaaggctcgaatacccactttagccccaaccttgtctgtttggtcttccatccaggggagaaaaacaataatatccagccttttttaaaaaaaattaattaatttttttgagacagtcttgctctgtcacccaggctggagtgcagtggtgtgatctcggctcactgcaacctccacctcccgggttcaagcaattctcgtgtcctagcctccctgagtagctgggattacaaacgagtaccactacatctggctaatttttgtatttttagtagagatgtgttttcgccatgttggccagactggtatccaactcctggcctcatgtgattccccctgcctcagcctcccaaagtgctggtattacaggcgtgagccaccacgcccggcccactgtccagccattattctcccaaggtagaggaggcaggagtttgcaggcagtagaccgaaggaagctgctgcatgcctttcttatcaggggaactgtggccccaacaacctggattatgcaggcacttcctctctgttccacatgaggcaccagcaactttgcctcattggtttccctttcctgatttctttctttctttctttcttttttacaatagtaaaactttttttttattattatactttaaattttagggtacatgtgcacaatgtgcaggttagttacatatgtatacatgtgccatgttggtgtgctgcacccgttaactcgtcatttaacattaggtgtatctcctaatgctatccctcccccctccccccaccccacaacaggccccagagtgtgatgttccccttcctgtgtccatgtgttctcattgttcaattcccacctatgagtgagaacatgcagtgtttggttttttgtccttgtgatagtttgctgagaatggtggtttacagcttcatccatgtccctacaaaggacatgaactcatcgttttttatggctgcatagtattccatggtgtatatgtgccatattttcttaatccagtctatcattattggacatttgggttggttccaagtctttgctattgtgaatagtgccgcaataaacatacgtgtgcatgtgtctttatagcagcatgatttatattccttcgggtatatacccagtaatgggatggctgggtcaaatggtatttctagttctagatccctgaggaattgccacactgacttccacaatggttgaactagtttacagtcccaccaccagtgtaaaagtgttcctatttctccaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattagaaaaagaggaagtcaaattgtccctgtttgcagatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggaactcttcaaggagaactacaaaccactgctcaatgaaataaaagaggatacaaacaaatggaagaacattccacgctcatgggtaggaagaatcaatatcgtgaaaatggccatactgcccaaggtaatttatagattcaatgccatccccatcaagctaccaatgactttcttcacagaattggaaaaaactactttaaagttcatgtggaaccaaaaaagagcccacatcgccaagtcaatcctaagccaaaagaacaaagctggaggcatcatgctacctgacttcaaactatactacaaggctacagtaaccaaaacagcatggtactggtaccaaaacagagatattgaccaatggaacagaacagagccctcagaaataatgctgcatatctacaactatctgatctttgacaaacctgacaaaaacaagaaatggggaaaggattccctatttaataaatggtgatgggaaaactggccagccatatgtagaaagctgaaactggatcccttccttacatcttacacaaaaactaattcaagatggattaaagacttaaatgttagacctaaaaccataaaaaaccctagaagaaaacctaggcattaccattcaggacataggcatgagcaaggacttcatgtctaaaacaccaaaagcaatggcaacgaaagccaaaattgagaaatggaatctaattaaactcaagagcttctgcacagcaaaagaaactaccatcagagtgaacaggcaacctacagaacgggagaaaatttttgcaatctactcatctgacaaagggctaatatccagaatctacaacgaaccccaacaaatttacaagaaaaaaacaaccctatcaacaagtgggcaaaggatatgaacagacacttctcaaaagaagacatttatgcagccaaaagacacatgaaaaaatgttcatcatcactggcctttcctgatttctaaagggattcctcaacccttgacaagctcactctatcattcctccaggaaagctgaacttagatgctgtggatgcaggttccacatggactttccagcttgggggcagtttccttcagtcacacagccccttgttttaagggaagatctcatgtaaagatatgagcagtggttatatccactcatcagagcaagatgacaagatcagataccaactgggccatccatgcataggggtacaagggtcaaaattcccaatgaacctttgcagtgacctgtggctaaatctggtttcctagtccacccacccaaacaccttttcagctaagttattggtggtctttgtctgataaacatttcaaagcttatttccaagagcacaggcatattcctacatattttgtacccatccctcctccccatattgacggtggtatattcagagaggcaagctaaagattcctagataagactgtaattacccagatagatttagctgggagactgcttggtgtatatgtgtgtgtttgtgtgtgtgtatgtgtgtgtgtgtgtgtgcacgcacgtgtgtgtgtgttttctggtgaaggaggcaatggtgttgggaataagatatttcccatgggtctgtccagttgttgggtagctggaaagttatattgcctcatttcctttctgtggccagagaggccaatgaaagtgtacatttgactgtaactccatgataaacaaagcaccccaactccaacacactcacataccccaattctgctagttcacagttaaagcaatcacatttaatggtatctgcagggtggtgtctctgatgctcaatatggccctggatcaaaacatacagatcccacctctcttctgttgggtcatttccaaaggaagaacaacaggcagatgtacacatcagcgggtaattcctacaactttggaaagattgctcaaagtggataagaaatagagcgagattttgatttcttatagcttacttgagttttttctgtcatcacaggggaatgcatctttccagactgagtgtcgaagaaacaagtttaatcaaaatctcttctgctgtgtgtttcccttcggtgcctccatcctttggtgcagagatacaagccgatatgctccaacgaatcccttcaggccacagcatgggagcaaacccaccctctttgcatgcagggcacagcactcacctaaccaggctgcaaattatagctgctgaattgtgccatcaggaaatgacagttgccttcatagccatcagaagtggatttggtaagaggagatttgttatcaaattgtcccttgctgtcctgattttacagagttccactgtgatggtctcagagggtaccagacagttaagtaatgagtacactcacccttttcctcagcactgtcataggctgtgtgcatgtgcacttgagtgagtgtgtgtgtgcatgtgcacacatgtgcaccccagtagagcaaaggaaacatttgtaaagaaaattcagaatccattcttgtccttgagaagcatatagtttagttggagagatgatatttacacatgattaaaaatatatttggcctggtattttctcataagggatagcttgccctttcctctgaggacaatttaagccagagttaaactgttcaagataaaactagaggctcccacacctttgctttaaaaaaaaattgcagataatagaagagaaattcattacttactcttttaaaggaaatatgaaagagtcagaccctctttacactttcatgtcagaaagctgaccaacctaataagaattctttaggaaatatgggattcccctttcctcactaataaattcctttggcttcctatgattcagttccaagtccataatgtccttctatcttcatttgtccttcattcaataaatatcagagtcttgtgctagggaccagggatacagtgctgaatgaaattcacagtctagtggggcagataagatatgcacacaaataactctaatgccagaatattgccatgaatttctgtaaagaagaaactagaatctcagaagaggcaaaggtcatttccagctgggctgagcagaataggaggaggaagagcagaagcaggtggtgtttgaatcctagaaggtaggtagagattgggaaggggaggaaggcattccaaatggaggtatgaagaaaggcacgctgactgatgggatgtctactgggggaccagcattgctggagcacagggttcctctaggagggtagtgagagataaggcttatacaataaagaagcatagacagtttttcaaggggataaaaggatgatccaaacagtgttttggtggcaatgagtcttggaaggggaggcaaggagcagggagaactgttaggaggctgcagacccagttcatatatgagaagatggtggtctgttgccttcgttaaatatattgtgattgcctatcattcagatttgtcttccccactagactgtacaactctcacatctttagagggaggacacagtgtctcattcatttttatattctccgtgtctggaacagagtagatctcactccatgtacttgttgaatgagtataaataggatgctgccagtgaaaaaaaggatgggggtggatatgagagccaatgtggttacagaacagacagaaccatcgatagtgcttctgggagggcacactcaggttacatagatgtgctatggagttcagcggaacttccctaccagcttctgttacttctgttcactctgtctttatttcagttcttcccagaaataccgacgataattctgttttactcactcttgatccttatcaagggcataaagcacaaggagaggtgactgagcaagggtgtcaactctctatttctaaagatctgaaggaacagccaacatttctatgttcttgtttaattgaaatcattcacctgcctggaggcatgtgcctgaaccatacaatgccttagttccttttctactctgggattctagaaggcattggaaacgtcacatgtgtttagaatgactgattattacataagcatttctgcatgggaatcgcatcctatccccaggcaaatatctcacccagagacatggcttgtttatcttgccccctaccccttctgatcttataagggagaagggggaatctgtcattagccatccatgataaaactgggcatttgtaaaacagtctagaagatacccagagatattatgaaggcttctccaacctgtcagtgggtggtgtttttgtttgtttgtttgtttgttttttgttttcttgatgggaggagaggatgtgttaataaagtctgaaaacagagaatgcagaagacgaaggatcaagagatcatgtaaacggagagtctccttcaagtgggagggcttcccacaaagggcaaggggcctgacgaaccgtcaactcagaatggaccagcagcagtgacacgactgatgctttggccttagtctgggaccttttcagtttagtagagcagaagcctttgccagggaaacaagcaagggcatcctggctacttttgcagccttgtggagaaaggcttgtctgctgtgcgagttgctaggcccctccctcagatctcagctgctgcggggttattacaattaggagcccacctgtgccgcctcaggccagtattcgtgccttgacaatcacttccttgttagctgtttctctgtggtcagcttttccccctgacacttgggacactcatgggcaatggtgcatcaaatactaacacttggggtgtgcaattttgatcctggtccaagtcaaatggaattatgaaaattagtgaactatgtaaacaacatcacactacctaataaaagcccaggcactaccactacacaagatgcattttaaaatcccatttggattatccactgttcagggtcatctatgtcatttttcctcctgatagctgcagataatagaaagttgaatggattagtgactggcctacctttacactgcagtcttccatcctgccaaatttcacttctgtttctgtttctctcatgctcctctcagagcagaacttatacttccacctgtgcaaacaatttgtccccttgtccacataaagaagcctcccttttacctcggggaattactcgagttcttttaggagggcctggtatcagtggtatagcagccttctaccgaccttagcactgctctgaccctgactagaagagtaggtcaaatgctgtgttctccaacttcagaaggacaagagaaaacttgaaggagtgctcagaactagccaaaggactagaggacaaaagtgaaaaaagtcagatattgtataaagactgtaggaggaattagtcacattatgaaggttggaaagttgctcatttctgtttacaggcaagaagggacaggagctgtgttttgttaaagactgctgttcagcaccagaatagactgcttcaggagaagaggtaccttctcctttcaacagatgctatttgaccaagagggtttcagtataattctggctggagttaagaaggtgggagaaagaacaaatggttattcagcctcccttttcatctcctggtgctacctattcctcttttactgctacttgaggggaaactttctagctctctagattttgtatggtcactctcgtaagcccacatgatcctctgttttctgttatcctgactctggataagccaactagcatgtgaatgggcacgttacttccctattctgggtttcggtttcttcatttgtaaaatgacatctaatgtctctttgtggccataaaatttcatgactacccccatgtggatgtctgtgtttctcatagcttagtggctcgagattggttactcaccaatgatgttagttgataccttttcactcactgttggccaaattctggtaacaggcctggaccccattcaccgtgagaatcttgcctaccacacagtgcctgcatcaatgtgatgccagtggaaaacaggcacacaaattgatatgacaacaaaattatcttctctcttcagcatcatcaattttcccctctatattagatcatttttatcagtatacaaatatgctgttatttctctcacttaaaaaactcttctgtttactctgtttctcctccagctctaatttctctgctctttacagcaaaactcctcaaaagagttctttactcactgtctcagtctctctcctcctagtcattctatattattattattgagatataattctcacaccataaaaatcaccattctaaattgtacaatccagtgacttacagtacatttgcaatgttgtgcaaccatcaccaccacttctagaacatttctatcacccccaagataaaccccatatgaattaaccgtcactccccattcattcttctccccagctcttggcaactacaaatctattttctgtctttatggatttgcctcttctagacatctcatataaatggaatcagaagggtcctttgtttctagattctttcactgagcataatgtttttgaggttcatccacattgtagtatgtatcagaacttcatttctttttatggctgaacactatttcatgacatggatatatcacattttgtttgtcttctcaccacttgataggcatttgagttgtttatatttctcagctattataaataatgttgctatgaaaatttgtgtatccattctctcttaagagaatattctactcaggctttggtccctcatgtgtcacagcgcctgctcttcacagtgctaaatcaagtggtcaattctaagtcctcatcttacttatcaggagtatttggcacagtggctcactctttcctcctggaatcacctgttttatttggtgctatggtctgaatttgtccccctaaattcaaatattgagactgaactgccgatgtgatagtactaacaggtgaggcctttaggaggtgattaggtcatgttgtctctgccttcatgaatgcaattagcaatcttacaaaagagctggagagagccagctaggtcccttttcactgtcccccttctgtcatataaggactcagcaggcagtgccattttggaagcagagagtagccctcaccagacactgactctgctggcatcttgaccttgaacttcccaacctccagaactgtgaaaaataaatttgttcttgattaattacccagtaaaaggtattttgttatagcagcacaaacagattaacacagttggcttccaggacattccactctcctagttttctttccacttcactggcctttccttctcagtgtcttttgctggttcctcttcataccctcaactcttttcttctctttctttttttttgaaacagagtttcgctcttgttgcccaggctggagtgcagtggcgccatctcagctcactgcaacctccacctcccgggttcaagtgattctcctgcctcaggcctcccaagtagctcggattacaggtacccgccaccacacccagctaattgtttgtatttttagtagagacggggtttcatcatgttggccaggttagtcttgaactcctgacctcaggtgatccacccgccttggcctcccaaagtgcagggattactggtgtgagccactgtgcctggcccatatcttcaattttaaacatggagtgcttcatggtcagtcttcagatctcttttcttcattgtctacactcactttcatggagagatctcatcccatctcatggttttaaatacaatctaaacaccagtacatctcaaatttcactctccaccctctcccctcaattctagactcatatatccaattgtctacctgatattttcacttagatgcctaactaaattgatcatatccaaaactgaattcccaatctcccacctcacaaccttccagtataatatgttccttgtatagtcttcccctcttggtaaatgaaaaccagttgctcaggccaaaacctttgaaggtatctctgacccctctttctcccacactcaatactcaatctctctataagtcctgatagctctactgtcaaaatgtattcagaattttagcacctcttactggcccaactccctggtccaagtcatcatcttttgcctgcattattgcaatagttcctcctgcttcccagttaggttcccctgtttccactacacagtccatttgtaatacagtgtgattttttaaaaaatgaaagttggcttatatcacttctttactcaaaactctccagtggctccacttcttagagtaaaattcaaagtctttacagtggcctacaaggccctacatgaagtagttctggttacttaattgatttcatgtcctcattaaccttactcattccacttccatcacaatggctgccttactcttccttgaatgtgtcaggcttactcctgctgcagggcatttatacttgctcttccctttgcctggaatacccctcataccaccccccaccccccagatattcatatggcttactcttacctcctacagatctttatgcaaaagtcaccttctttcttggtgaggcctttcctgtccacccaatctgaaataaaaacctcttctgctccacccacttgatctcccttactttactagatttttctccatagaacttatcaccatttgaaattgtatacatcttcctcatcttcctccagtacaatataagttccataaaagtagggatttttatctgttttattcatagctatatccccagcgcctagaacattgtatggtatgtagtaggtgctcatgtgtttgttgaataaatacatgaatggttgaactggttcttttgaaaactagttaatacttcagccatctcttgctgggggactgaattccaccattagctttcaaaatagttgtttgcctaatttcagctgcagtgtgatccggcttgagtttttaaaaaagacattaaaacttctcattagaaattttatcttttctaagggtagtatatttaaaaacacaggctcttgctggttgaatcctgggtatttatgtgaatcaggacaagttaactattttgtccttcagttttctcatccataaagtgggcatacttaggggcacctatcccatgttattatggggatcaaataaagtcacatatgtaaattacctagcccagtacctggcacttagtaaatctttagctaaccgtagcttttattactcttattaagatggaagagaattactttcaaaaaacagaggaagacttgcaactgaaacaactgaatacatttttctaagtgaaaccaaaatagctgtctggctcttttgtacagatggcatttctttggaaaatgatccaaaacttgaaggccaattgttttgtccctttcttcaagaggctttcatgggactggacatattctctatatcctcccaaaatagtcacacttggaaccccttatactttaacatctccacttctcacattcttcaactttgatgccattccagactctgaattcagattccatggattagctcactcagtatactggtaaaaaactcagcaattccttttgtggggaaaatgcttcccgagtgccaaaagaccagctttctagatgggcttacttgcaaacaaggtcatccatgccttaaaaggcaaggacaatggtctctatttctgtgttacggcacctcctagtagcttgctgtcagacacattttgtgttagttccccattaaacaaagttatcacagttccagtctataaatgccaaaatgtgctggattattcaacttgtgcagggaccctgaggaagcccaatcccgtacagagcatttggctcttccttttacagaagcagccaatggaatggagcctctcctattcagcatttgccccacataattcttctcttgctttccagggtccacttcttatatttgaacttctctcttacctcccacagcaacttatactgagctgggctgggctgggcatacattcatttattcattcattaaaccccacagggctcaataaatagttgttaagtcacactgcttctttgctgctttagaactacagttttgttatttaaatgaaattgtaccttatcttcccagggatgttgtaaatttcttgagtacttgtacttctacctcattcctgtctcctgcagtgccacacttgagtcttccttgatgcagtctgtttttattattatgctctgcaaactgctctggaaaaatgggtctgaactctaggaattaggtaaaattttctccttgacttttcattttttaaaatggtggttgttaggagaaaacagcatgcaacactcagcaattactaaggcattttcccagtataatacaatttcaaataaaaacctaacaaagcccatgtcaagaattagaaacttactcataaacggttgtccatccattttcgttacttttggtagccagaagccctgtgtttcctggataggtcattaaggccagattatagccttgggctgacactcttttcaggactccattgctgcttatagtcagccagtatacttgtccgccaggcaccacaagccatagcggcattccgcctgcatcacggcgaatgtgcactgaattgccattgctgctggtaatcgcgcccaagtcaccttcagaattgtaggtgaagttataaacatagtcccttgttatcaagttcagggtgtgtaggtgggttccatttacagtgaactggtacagttcctgatcagcgggtgaagcaatctcataaatgttcatgtcattcaggtgggcttggttcctgctgatggtacgaattcgaacatttccgaggtctgccacatagagggttccatcaggcgacactgctaaggaggaaggggctttcatctttgcatctttggcatagccaccatcacctgtgggagaaagacttgattttaacaattggcatcataagcatttacatgaacataccacagacataaagctctgtgcatcaagaatcattttaaaggaaacaatcagtgaaccaacattctctgtattccctccctgaaaaatatgaagcctattattcaaaagattgtaattcttgagtcagtaccactgcagatgaacagtaagatctaattatctcagttataccaattttgtgaaatcctcaatcctgctgttcagaatctattgtattataagaaacaagaactgcaaataatgatagccacacaaaatttggctggaaatctgagagttatgcctgtcaatgctttcaggatctgtttcaggactttccagtcctactgtgcctagatgccctttcttctgttaattcccattgtcacactgtcaaagtacactaagtctataagtacaacaatgattcagaacatcaaatttgatacctggaataaacattagatttgctttgaccgaaagatacaaattagcaaaatatctataaaactaattgtcgaagaaaacattggaaatattgatcaaaagtcatattgaccaaattgctcactcctgactcctctggcctaaggaaaggcaaaggttaagagaaccattcgggcctggatgaacagtttaatagcactgcgtgtagtatggagggatttccacatcccagcaataattgtatctgttgacattaagaggaccgtttgccatctgagatatccactacatgttttggggagaaggctcttttttttttttttttccaatttcgattagaagaaaacttcactatgggttattgagaaagtcttagctttttaaaaagcaatgtatctagcagaccaatgtcctgagaactctccattgccagatttaattttgctcatctatcccaaagacagtctgttcttagtccctttgagtctcaaatagcacatgcttttaatctgaaaaccaaccacttatggggaagtaattttttcctcagctaaaccagtaaatgtgggttttacctagttttcctttctctaaagtacaaatatttaataatatcatgatctttcatttgtatagtggtctcaactttttaagagtctaaacatttttattacactagtttatcctcagaatagcaaggtgatataactgagacaatgccatctttattaaacaaatgaagcaaatgagtcatgaagagatcttgcagctttgctagggtcactcagtgagtcagttgtgagaacaagtcggtgatctgactcctaatccatcgctttctccactagctcataccaatgtttgcaagtaacactttgcttttccttttccttttgactttactggggcacgtttttcttttcaaaacagagaggggaagctggtgaattgctaaaaaggtcatacctgaaaaacagtcacagtttggatcaattttgcagtcacagtcagtgggggcaccagcgatgatgtagatctccccattggtggttacttgctgaatgcggtttactttcctctcgtctgtttcagctatgaagagcagcccgctgtgggagacactgatggccctcgctgactctagagtggagtgaattgctaccttgctgaccaggaaatgatcgatgcctggcacctggcagtgaatggggcgtcctgcgatgatccgaacacgcctgttctcagaaatttgcagcacaatgttgttatccaagacatacaatgaattgtccataggatttactgcaaggtctgttggccactctaatcgcacctgtgaaacgaacagaacacatacca

SEQ ID NO: 3695 - DNA, 9128 bp, human
cggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggaggtgagtgcgcgccctcccgctcgcccgggctgcagccggcgtgctcctttccctccgccctattcgcactctccccgcctcccggggagcccggcgcgagccgtgcagtagcagccacgcgccggccagcgccaggcagcagattgacagagcgccccgagccatggggcggctggccacaaggactgcttcttttgcggggctcaactcggcctttggcatcacctgcccgtcaccttgtccctcctaaccgtcgctcgcagtcccaggagctcaggaccacaggtgtgcgccgcgtgtcccacgccctgcaccccgcgtggtagaggtggaggcgggggacatgcccgctccctcgtggatcgatggaaggaactgaccagagtcgagtgggctgggctcccatgttgaacgtcttctggtccctgaaggctgggagcctcccgccagtccaggggcgcgggaaaccggggatgatgtgccaacatgcagacgtgacacttgttgcataggcaggagtgcgcggagggggtggcggcatggagcccagctgttgctcctttcggcctgcatgtgtgagcagaggcagcctcccccaggcagggccgggcccagccgggctgggctggtcttctcctccctaaccccaaggtcctggctggtctcctcccctgcacaggatgccctccccatagcctccatcccacccccagagacttggttctcttacatcctggctccagccttcctttctgtcccaggcacggacatgcttcactttagtctccctgccgctaggcaccaaaggaggaagcacagcacctgacccgacccctccctgcagctcaggaaaggggagtccttttgccctcacctgccaatacttggcactagtgcccatgtccgcccctagcctggtccccaaccacgccccagcagccccatcccaggctgcctgtcctctgtgtcaatgtctcctggggctgccagctcccacctccagctgccacagtcctatgatctggctgtcattgctgcctgcctggcaccacacaaggggaaggccaagaccaggtggactaacgccaggaccatggctggagtcacagggaggtgggagcagaaagaaggagaaggcagggcagtgagtttcctggggcaagggcacagggccctaagtggttccaaaccctccagaacaggaggatggcatgcagcccaggagcctccgaggggcccagccagctctgcctgcctctcatcgcaggccacctcctttctctgctcttgctttttggccctgctgtggctctgggaacactgcctggcttctcagaaaggtgcagtggttggggctggcacctcctgcctccaggtagctggccggtgatttctctattcaagacctgaacacgaagtgagccaccaccacagtaagaagtgggtaggctttttccacagaaactcctgtcaggcaggtaacagagggagcaaaagatacgaatgtaagatacgaatgatacaccataccagcctatcctcagggagcctaccatctggtgtcattggcaaggcatgacacttgcacaataccaccacaggcaaatagtccagggtggtgccttcagggaagaagaagactgggtgcagagagtgttccagaggaaggtagggctcctggatctgcacacttggtgctccccccagaggctgtggggagacccctggccaatagacaaccactcagaccctcctgggtcccagccattgggacagtactagcaaaggggagagagctggtttcaagggaagggaagtcagccaggatgcccgaacaccatgtggctggtccagagcctgccacttcgtgctttaattcccccgtcttcattaggtcatctgtccactgtgatttggataaattcgttgccctcacattttgctcaagcctcgtgctggaaactttcagggctctcactgacttctctactccctgacttctcctggagccaaggaagggcatgtccctggaagtggccaccagccaagggtccaggtacacatgtcctgctcccgctggctcctgtcctgggttagaagcaggaatcccagaaccactttgtccttggcccggactggcatgctgtccccagccagagtccccagtcaaagttccagcctgaaaaccacacttcctcctctccacagtctgtcctgacttgaaatgtccacccccgacccctctccacgctgcctctcatcaccccgctaccaccacgtacactcctccactgcctcctgacctgggatacactttgctcttgtgagtctgagaactcctggtccagggccaagtgtccctcggtctctgagcacccctctttttccccttctcctccccctccgcaggcccagctcaaagcctgcagtcacagtgggagtgtgaggagagcctactgtacccctcctgctcagggaagggcatctctactccatccccagtcctcagcactaagcacccgtgtaacctgagccaggcctctcctcgcaaagaactaaggcaagggaagcagagggccaccagacagagcatgatgtatcccagggcagcaaagctggcactggagacagcacagggccctggagaaggcgactgggatggggggctgggcagacaaagagacacatgcaggaccacagagcagtggaggggcattgccagcagggtccccaccggagcatacgtttgggcttttaaagtcatcacaagacaggccagactgagagaggaaaaacaggtgcgtcattcctgatgagactggcatgttcctgaaaagtcgcaagtacctctttgtgcattggcagggttggagttcagatagcatgaaagtcaaatcctgtcctccccctgactgtggttctcagcgtggagatgttgtagcttcgtggctgatggcacttcagcaggcaatggctccaatctctctaggctcgagattgtttggaggattgctccagcctccttttacgtagcaaatgagctggaagaaaatatttaagtgcattagggctggcctccatttctaaaggggaattcttttttacagtcaagacttctgcagtgatgagaatcaacagcctctaatttgttcctttggacagcataaagccagggtttcagatgtcagcttatctgatggtgagccagactcagaatcaaaagtaggaaacaggtgggtgacgggctcagagtgcgggaggagccagcagatctcggtgatgctgaggacaatgagtccccaacgcaatgggagggatgcaagaagcctggggctgctctccagggcccggctgggggttcagtcagctcagagtggttcttctctgcagacctagagtctagacatcttcctggccagagccaccaaccctgctccccatcctgacatatggcctctagccctccctttctgactgccagacactcacaatctgagcacctggagatgatgccctccccctcctggcaccatgcttctcttctccatgtctgccaccaccctgagctacaatggcctgcaccactgccccatcccttctgcacccccagcagtcgaaggtgcagaggtgagagccaagtgttgacttggttcacttcacaaggcccctaggtccttcccctgctccttatcagcatcattcagatccgccctcagtgatcagggtgagccttgtggggaccccagaactcaaggcagaggctgaagcagctgcagtggggagcttagtgaaggtctttccttcctttccctctccagccccagccccctcacagatggcgccaagagggtagctctatgacagtcagacagaagcagcccccttgttccatccatacttactgctccaaagtgctaagataattcttcttttaattctcataggttatgaatttaagggataagttggcacggaagtgtggctagttaaccaaatgacccaagtcaacagcggggtcctcatgggcctggcaatttttcttggggaaagagggaaggagggtgcaggcttggagaatatgtgtttatgtgtgtgtgtgtggagggggtgggtatgtctgggtgtgagtggggagaactgcaggctcagaagcctgggggaagagggccctaaggccaaacccacccacttttggcccaagaggaggctgaacacttggaaattgtgtgcaagcagaggaggactcacaaaaaccaaggagccaaggaaggaacagagcgtggggatgttggaggcagaggcagaggggaagggggagctgccaggggtatgattggggtgtgagcagccaatgggaggctctatggaaactgtgagcaagtggtgggaattcctgggtagatggcaatggggctcgagggacagggatctagatgcaggcaaatcagatggtgtgcagggggagagagactgttattcattatctctggcctcagatgctgtatctgcacaggcctgtactggacattgcacaagtaccctgcctggctgcctcttccccagcaccatctcatctccacacactgcctgccaccaccagccaggcttgtcttgggggtggcagctcagcttccctgcatggactgcaggcttcacgagagtcggcctgcatgccttttccctcactgcacccaaggataccctgcaccacttggattccattgtcagggctcagtctggtgtcaggaggcctctactctaagcctcctgacagatgtggacagatgtaaagaggagccccagagtgcagaatagaagccagctgggattgaaatggaaggaatttacatgagacacaggatgcagggtgtgatctgggaatttcaggaggtagggcattggtggggaggtaccaactgcaacagcccacccccctcctggtgcacagacatgctgctgaaggtgaccattgtttcatttattcattctcaaatattcatgcaatatttattggtctctaaatctggtctcaggtctctaaatctggtcacagcatgaggcaggctgagtcagagacctctcccccttaacccgcctggcccagccccatccactgggaggacttggcgccctagagatgcctaaccaccgatgagacacccaggggcgagatatgagctccctagtactcacaagtgggtcatcctgcatatcaaaggatgtaggagtacaatgacgtgatgttcgggatttgctttaaaatactgcagtcaaggaaaatagaaaagggataactaaagcatatgtgactccatctggataactgttgaatctgggtgatgggtccatggcggtgggagggtcattgtaatgtcatatgtctgaaatgtttgaagtgtaccagttgcaggggtgccgtggtgattactgcctcctgccccccagccaagtacaggcgtgacaacccaaagtgcacaccccccaatgacgttccaaagaaagaacccacttgtgcctgtcagaaacatgatataactgtcaaaaggacagaaagtcagctacatcaatggcaagatgtgagtagtaggttccgtttgtcccaggacagtgcagaaatggcaaattttccctcaatatgaaaaaaagaaacaaagaaaatctatgagaagtgccaccacatggacagaccacccctcccgcgggcctgtggtctgcagcccctgcccgtttccaacaaccttcctcactaacaggctttctccttcctgcagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggtacttgagcctctgttcagtggacagtgctaaagcggagggagaaggacagcctagaagccgggtgatcctgccgctcatcactggccagacacatccatcaaacagtcctggcgccacactcacagaggcttagagctggcaagagagcttatggggcagctgtctagcccctttattttacagacgatctcctcgtctgaggcctagagaggggcttgatacttggggccagtctcccttccaccctgctgcctggggttggggaggctggcctgcttagagatttctagacatcctggtggaccttaatggctggggaggggtgcccagggcaaacctacagatgtccagtgtagattgtcgccagagttggggaaggaggcagagagctctaggggctctcaggcagagaacaagaggacagttgtggctgtggttgcccggagctgtgagaaggagggaagaaccaaggtggcagcagagagaggagagctgaagcctgccccttccctggtctgctggctgtcccactgcagtggggacaggcaggcaccaactcaggggccttgggattgaggtttgggctgagtggagtttgggggaaagagaaggcggtctcctctctcctctcctttcctggggagttcctttggcctaggatatgtccatgacttctctcttgtcatttttgtctccttaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctg

SEQ ID NO: 3696 - DNA, 1089 bp, human
atgggctggaagacggcaatgtccgccacctggtgcagcccagagggtcaaggaatgggccagggccctggcagggaggtcggaggaaattccgccgccagcggccccgcctctcccataagggacccatgcctttctgaagcaggtacttgagcctctgttcagtggacagtgctaaagcggagggagaaggacagcctagaagccgggtgatcctgccgctcatcactggccagacacatccatcaaacagtcctggcgccacactcacagaggcttagagctggcaagagagcttatggggcagctgtctagcccctttattttacagacgatctcctcgtctgaggcctagagaggggcttgatacttggggccagtctcccttccaccctgctgcctggggttggggaggctggcctgcttagagatttctagacatcctggtggaccttaatggctggggaggggtgcccagggcaaacctacagatgtccagtgtagattgtcgccagagttggggaaggaggcagagagctctaggggctctcaggcagagaacaagaggacagttgtggctgtggttgcccggagctgtgagaaggagggaagaaccaaggtggcagcagagagaggagagctgaagcctgccccttccctggtctgctggctgtcccactgcagtggggacaggcaggcaccaactcaggggccttgggattgaggtttgggctgagtggagtttgggggaaagagaaggcggtctcctctctcctctcctttcctggggagttcctttggcctaggatatgtccatgacttctctcttgtcatttttgtctccttaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactg

SEQ ID NO: 3697 - DNA, 9693 bp, human
gagcattctctctggcagccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggaggtgagtgcgcgccctcccgctcgcccgggctgcagccggcgtgctcctttccctccgccctattcgcactctccccgcctcccggggagcccggcgcgagccgtgcagtagcagccacgcgccggccagcgccaggcagcagattgacagagcgccccgagccatggggcggctggccacaaggactgcttcttttgcggggctcaactcggcctttggcatcacctgcccgtcaccttgtccctcctaaccgtcgctcgcagtcccaggagctcaggaccacaggtgtgcgccgcgtgtcccacgccctgcaccccgcgtggtagaggtggaggcgggggacatgcccgctccctcgtggatcgatggaaggaactgaccagagtcgagtgggctgggctcccatgttgaacgtcttctggtccctgaaggctgggagcctcccgccagtccaggggcgcgggaaaccggggatgatgtgccaacatgcagacgtgacacttgttgcataggcaggagtgcgcggagggggtggcggcatggagcccagctgttgctcctttcggcctgcatgtgtgagcagaggcagcctcccccaggcagggccgggcccagccgggctgggctggtcttctcctccctaaccccaaggtcctggctggtctcctcccctgcacaggatgccctccccatagcctccatcccacccccagagacttggttctcttacatcctggctccagccttcctttctgtcccaggcacggacatgcttcactttagtctccctgccgctaggcaccaaaggaggaagcacagcacctgacccgacccctccctgcagctcaggaaaggggagtccttttgccctcacctgccaatacttggcactagtgcccatgtccgcccctagcctggtccccaaccacgccccagcagccccatcccaggctgcctgtcctctgtgtcaatgtctcctggggctgccagctcccacctccagctgccacagtcctatgatctggctgtcattgctgcctgcctggcaccacacaaggggaaggccaagaccaggtggactaacgccaggaccatggctggagtcacagggaggtgggagcagaaagaaggagaaggcagggcagtgagtttcctggggcaagggcacagggccctaagtggttccaaaccctccagaacaggaggatggcatgcagcccaggagcctccgaggggcccagccagctctgcctgcctctcatcgcaggccacctcctttctctgctcttgctttttggccctgctgtggctctgggaacactgcctggcttctcagaaaggtgcagtggttggggctggcacctcctgcctccaggtagctggccggtgatttctctattcaagacctgaacacgaagtgagccaccaccacagtaagaagtgggtaggctttttccacagaaactcctgtcaggcaggtaacagagggagcaaaagatacgaatgtaagatacgaatgatacaccataccagcctatcctcagggagcctaccatctggtgtcattggcaaggcatgacacttgcacaataccaccacaggcaaatagtccagggtggtgccttcagggaagaagaagactgggtgcagagagtgttccagaggaaggtagggctcctggatctgcacacttggtgctccccccagaggctgtggggagacccctggccaatagacaaccactcagaccctcctgggtcccagccattgggacagtactagcaaaggggagagagctggtttcaagggaagggaagtcagccaggatgcccgaacaccatgtggctggtccagagcctgccacttcgtgctttaattcccccgtcttcattaggtcatctgtccactgtgatttggataaattcgttgccctcacattttgctcaagcctcgtgctggaaactttcagggctctcactgacttctctactccctgacttctcctggagccaaggaagggcatgtccctggaagtggccaccagccaagggtccaggtacacatgtcctgctcccgctggctcctgtcctgggttagaagcaggaatcccagaaccactttgtccttggcccggactggcatgctgtccccagccagagtccccagtcaaagttccagcctgaaaaccacacttcctcctctccacagtctgtcctgacttgaaatgtccacccccgacccctctccacgctgcctctcatcaccccgctaccaccacgtacactcctccactgcctcctgacctgggatacactttgctcttgtgagtctgagaactcctggtccagggccaagtgtccctcggtctctgagcacccctctttttccccttctcctccccctccgcaggcccagctcaaagcctgcagtcacagtgggagtgtgaggagagcctactgtacccctcctgctcagggaagggcatctctactccatccccagtcctcagcactaagcacccgtgtaacctgagccaggcctctcctcgcaaagaactaaggcaagggaagcagagggccaccagacagagcatgatgtatcccagggcagcaaagctggcactggagacagcacagggccctggagaaggcgactgggatggggggctgggcagacaaagagacacatgcaggaccacagagcagtggaggggcattgccagcagggtccccaccggagcatacgtttgggcttttaaagtcatcacaagacaggccagactgagagaggaaaaacaggtgcgtcattcctgatgagactggcatgttcctgaaaagtcgcaagtacctctttgtgcattggcagggttggagttcagatagcatgaaagtcaaatcctgtcctccccctgactgtggttctcagcgtggagatgttgtagcttcgtggctgatggcacttcagcaggcaatggctccaatctctctaggctcgagattgtttggaggattgctccagcctccttttacgtagcaaatgagctggaagaaaatatttaagtgcattagggctggcctccatttctaaaggggaattcttttttacagtcaagacttctgcagtgatgagaatcaacagcctctaatttgttcctttggacagcataaagccagggtttcagatgtcagcttatctgatggtgagccagactcagaatcaaaagtaggaaacaggtgggtgacgggctcagagtgcgggaggagccagcagatctcggtgatgctgaggacaatgagtccccaacgcaatgggagggatgcaagaagcctggggctgctctccagggcccggctgggggttcagtcagctcagagtggttcttctctgcagacctagagtctagacatcttcctggccagagccaccaaccctgctccccatcctgacatatggcctctagccctccctttctgactgccagacactcacaatctgagcacctggagatgatgccctccccctcctggcaccatgcttctcttctccatgtctgccaccaccctgagctacaatggcctgcaccactgccccatcccttctgcacccccagcagtcgaaggtgcagaggtgagagccaagtgttgacttggttcacttcacaaggcccctaggtccttcccctgctccttatcagcatcattcagatccgccctcagtgatcagggtgagccttgtggggaccccagaactcaaggcagaggctgaagcagctgcagtggggagcttagtgaaggtctttccttcctttccctctccagccccagccccctcacagatggcgccaagagggtagctctatgacagtcagacagaagcagcccccttgttccatccatacttactgctccaaagtgctaagataattcttcttttaattctcataggttatgaatttaagggataagttggcacggaagtgtggctagttaaccaaatgacccaagtcaacagcggggtcctcatgggcctggcaatttttcttggggaaagagggaaggagggtgcaggcttggagaatatgtgtttatgtgtgtgtgtgtggagggggtgggtatgtctgggtgtgagtggggagaactgcaggctcagaagcctgggggaagagggccctaaggccaaacccacccacttttggcccaagaggaggctgaacacttggaaattgtgtgcaagcagaggaggactcacaaaaaccaaggagccaaggaaggaacagagcgtggggatgttggaggcagaggcagaggggaagggggagctgccaggggtatgattggggtgtgagcagccaatgggaggctctatggaaactgtgagcaagtggtgggaattcctgggtagatggcaatggggctcgagggacagggatctagatgcaggcaaatcagatggtgtgcagggggagagagactgttattcattatctctggcctcagatgctgtatctgcacaggcctgtactggacattgcacaagtaccctgcctggctgcctcttccccagcaccatctcatctccacacactgcctgccaccaccagccaggcttgtcttgggggtggcagctcagcttccctgcatggactgcaggcttcacgagagtcggcctgcatgccttttccctcactgcacccaaggataccctgcaccacttggattccattgtcagggctcagtctggtgtcaggaggcctctactctaagcctcctgacagatgtggacagatgtaaagaggagccccagagtgcagaatagaagccagctgggattgaaatggaaggaatttacatgagacacaggatgcagggtgtgatctgggaatttcaggaggtagggcattggtggggaggtaccaactgcaacagcccacccccctcctggtgcacagacatgctgctgaaggtgaccattgtttcatttattcattctcaaatattcatgcaatatttattggtctctaaatctggtctcaggtctctaaatctggtcacagcatgaggcaggctgagtcagagacctctcccccttaacccgcctggcccagccccatccactgggaggacttggcgccctagagatgcctaaccaccgatgagacacccaggggcgagatatgagctccctagtactcacaagtgggtcatcctgcatatcaaaggatgtaggagtacaatgacgtgatgttcgggatttgctttaaaatactgcagtcaaggaaaatagaaaagggataactaaagcatatgtgactccatctggataactgttgaatctgggtgatgggtccatggcggtgggagggtcattgtaatgtcatatgtctgaaatgtttgaagtgtaccagttgcaggggtgccgtggtgattactgcctcctgccccccagccaagtacaggcgtgacaacccaaagtgcacaccccccaatgacgttccaaagaaagaacccacttgtgcctgtcagaaacatgatataactgtcaaaaggacagaaagtcagctacatcaatggcaagatgtgagtagtaggttccgtttgtcccaggacagtgcagaaatggcaaattttccctcaatatgaaaaaaagaaacaaagaaaatctatgagaagtgccaccacatggacagaccacccctcccgcgggcctgtggtctgcagcccctgcccgtttccaacaaccttcctcactaacaggctttctccttcctgcagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggtacttgagcctctgttcagtggacagtgctaaagcggagggagaaggacagcctagaagccgggtgatcctgccgctcatcactggccagacacatccatcaaacagtcctggcgccacactcacagaggcttagagctggcaagagagcttatggggcagctgtctagcccctttattttacagacgatctcctcgtctgaggcctagagaggggcttgatacttggggccagtctcccttccaccctgctgcctggggttggggaggctggcctgcttagagatttctagacatcctggtggaccttaatggctggggaggggtgcccagggcaaacctacagatgtccagtgtagattgtcgccagagttggggaaggaggcagagagctctaggggctctcaggcagagaacaagaggacagttgtggctgtggttgcccggagctgtgagaaggagggaagaaccaaggtggcagcagagagaggagagctgaagcctgccccttccctggtctgctggctgtcccactgcagtggggacaggcaggcaccaactcaggggccttgggattgaggtttgggctgagtggagtttgggggaaagagaaggcggtctcctctctcctctcctttcctggggagttcctttggcctaggatatgtccatgacttctctcttgtcatttttgtctccttaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaa

SEQ ID NO: 3698 - DNA, 9128 bp, human; identical to SEQ ID NO: 3695

SEQ ID NO: 3699 - DNA, 9693 bp, human; identical to SEQ ID NO: 3697

SEQ ID NO: 3700 - DNA, 13221 bp, human
gggtccgtcccgggaatgcaggcaggggagggtgtgggccgaggcgcggcggcggctggagcagcgcggtagggtccttcgccagagcatccggtccgagggcgcacacaggcagaaggctcgcggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggtgatccagggggtcaggtccaggaagggtgggacccgggaggggacctcgcccgaggcatagctctagcggttgtcgtcgtccagcgtccagcgcgtggcggtttcgcctcttgctgagccgaggaccctcggctcctcctcaccccttttcacctctctcagcggggccccgtccccacttcactcagttttttagggcggttgagaatggggttgcattcttacccttagcccctgcctgacaggtcctgccaggaaaagcatgttggattcccatccatgacccctaccccgagcagcggcacctgtgggcagagggaggcaggaggcatctgtgggtcctagtctctgggatggatcccaaagcactttacacatcctgatgtctcttctactgcttgggtgccgataggctgcaaaaccccactttggctaagcctcaaggcgttagagggaaggaaatgatggaaatccatggagaatgaaaaagctgctttattttaaattgcagtttatagttaaaaaattagggctgagttgagatggcggtggagtggggtggttctggcagaaagccatgagcccttttaaagaaattgaggcagggtccagcccttcgtaatagacaaaacttgtttttttgtaacagcccccctggaatgatatcttctttacttgtctggggcatctaatacatgaactgctccttattcattctgttggtattgtcttcaggtctttgtaaaaatgcagtgacttaaccgagggccaggggaatgttcaatcctccccctccatgagtttatgtaataggctaagtgcaaatattcttgtctgaccatttgtgctcacctttaattcagaaaaggtagaaacctgatatgacaggaatatgtcaatgtgcaggggatggcgggagggaggacataacaagggcaacttcttgtgtcatggggagcagaggggggcctctataaaggcactgggatcactgaagacaactcctctaggctcacagctggcctttccttgagcgtatggttggaccttagacagagtcaggggtgacagtaagcctccttcttgctggtcaaactgccaaagtgaccacaaggcccctcctctgagtgacgtggagagaagggctgagtaactgatgaaactgatgaaacacttgaaactgtgcgagactcctgactccttgattattaaaatgaacgtgttctaaaaatggcttcagaaactaggccaactcactagatgtcaggaagatggacagctcagtactgataagggagagccccagggtaggaagatagaacattattttgaaatcgtgatcttttttgccccttgcattttggaagggaagtgctacatttccttttaaagtcaaaggcggtatctgtctctgtcctttcctggggctgttgacatttgcttggttaagacttcctctagtgtgtctagcttctttaatgtaaggctataagattctagaatttctaaaacatgactttgtaatccaaagtagaaatatctttacagatgggctcttaaacctcaaaaacctaatgctcccatttgcttaaaatcaagtgctacagtgagccaaagagttccctggatttaaaaggtgggaaataagtccatctgaaatttagatggaaaaaatgaagtgtttgggaatctaaagaaggagggaggaagaagctagaaagtgagggatgacagatgaacacgagtggaagagtcaccacccagtggccttgaaggaatttttaaactattccttctcttctaacaccccagtacttagccaaactggactttacagtctctggcaaagattccagactttttcccagagggcagagcctgtgacagtgtgactcactagaaacagagctcagcacaacaccacgtgcagataagtgcttaatacaggcttttttggggaagatgatattttcaaggggacaaagccttgtgacactgctcatggaggagtcctctgagggcagattccaaaggagctcagagtggcgtgtgggagtggggagatggtgaccctgcttcttgtaaagctgctgcaatctcaggaccatgctggcaggcgagagaccagcatgtctgtgggaagatggcagagcctggcggctagcacgtgatctagataagagaagatttggcctcgcactctggctagcctgaagttgttcaaggaatacatgccaaagccatgcttggagatgactgccaagggcttcgtcctttgcgagagagagaaaagtccagtgtgacagtccgaggtctggcctagaccatggccagcaatagaaggcttttgggctgtaacataccagcccttggaggagagtggtagagaggtctcagccagctcttctcagtctaagagcaagggtgtggcctcttctgggctgcctgcctgtgtcccggggtagcacatacatgaacccctgctagggacaactgatttggtgtagttagagccacactgtaattaattatcaaggccatccctagggtattgaagccccatttgctgtctccaatcattatgttccccaccctcaccccatcaaagcatttacaattgagtcctgatgaactcaattgtatgaacatcaagaaaagcctccaatgagtaggcaataataataataataataacaactatgtattgaataagcaaagagcccaggctaggcactttacatgcattatcttatttactcctcacagcagctttatgaaatcagcagtattgttatcattcccattttatagataaggagactgaggctaagagagatgaaataacccagtggcacatggatctgagcttcagcctttgactcttgagcccaagcacttcgccacctcactatcctacctttcctgttacagggccacgatttcaacccagattcagagaccatgccctttaccactgcatttcactctacaggacaatattcagtcccctagattgggggagtttgacagggggagatagaatgccaggcagccagtcttgctctttcttctaggccagggacttagggttatagcccaaggcccccaggagcctttcagatgtctccttcaatttgtatccaggacacacagaactcaactgggtttactttttttttttttttttttttgagagggagtttcactcttgttgcccaagctggagtgcaatggcacgatctcagctcactgcaacctcggcctcctgggttcaagcagttctcctgcctcagcctcctgagtagctgggattataggcacctgccatgatgcccagctaatttttatatttttagtagagatggggtttcaccatgttagccaggctggtctcgaactcctgacctcaggtgatccacctgcctcgacctcccaaagtgctgggattacaggcgggagccctgggtttactttttgcaccttgattatctcaactcaggtgtgagatgcagaaaatgttcagagataaaagagatgttacagattctgtgatccagtgtcctcctcttgcagataggaaactgagactcagagagggaaagtgacttgcccaagatcacacagggccaggcctagaactcatgtctcctaattccctttctggtgctctttccacacatcatgctgcctggcacaaaatcctctctccagcctagctccatggtccatccaacccacaaggccacctatgacaagaatccagagggacatcataagagatagctgacagtctttcctgacatcagcctaggaagggtggaggcatcccccagcccccaaaggaagagtggagcttcccttaatgactatgatgtgtctgtcacctacagatgtagctaaatttattgagtctgtctcctaaatgcattggaaaatgccgaataggggtgtgtgtgtgtgtgtagagagggagggtatgtagtagaggggaggctaagaaactaatttttgaatcattctttgtatatttgcatggaagcttcacttctgtctataatagtttggttcctcccacaggctgggcactccctgtgccccagccctggggacaagacaaactgcaggtcagctgtggctatgggcaggtacagctcaggactgtgagtttctgttcctctactgatcactgggggaaaaaaaataccttcctgtgttacattatcaagtggatggaggctgagctaagtgttccttggaagctgcctgcagtcagaatgacatcatttcttccttagggcttctgagcttctatcttctgccagttaacttaatggttaattatccatcagtgtaagtttctctgtctcccttgctgcttctttctgtgtgtgagtttctctttgtctctgtcctcctttgccattctctgtgtcagctttgtgtgtggatcttagatgcagatgggacagtccagctagttgaaaacaggtttcttttaaacttttcccatcatccactggggcatgctccagaggttacagatgtatttgtctcctttttttgcacttctaccctcccccatcggcctccaacaaaagcacattcatgcctcatctatagaaagatgccagttaatgtttcctagggaaaagaaatccccctgtcagctaagagcacatgcagggggttgggggcttgctgaagctcgcccagaaaatagttcaaaaggttagatatctctttggcagttccccatgctgtgcccctccatcctcctccagcaccccatcagttcgggcctgcccccggccacccatggcatgttgccagtattcctctctccaccccctccccactggatggcctttagctctgtctcaccttcgagaagccaagctttctgtgatttccaggatgagagaccaatggacccaaggaaccataccaacaggagagggcttgatggcctttctgagaccagagcaacaactaatatttgcagagtgcttgacattttccaaaagtcctttctcatgtgttatttcactggatcatcccagcaaccataggaggatcaaggtcccattgcagagatgagaaaaacaaggctcagttcagggaggttaaaagacttgtctggcatttactcagcttctgagcagaagagctgggatgcttgctgcctttccaacagtgcttgctcaagttgttgcccatctagacttaatggtggaggtttcaggccatgaaagaagggagagtgtatattaggcactgggtcacatacttacaaggactactaatcctcatagcatccctacctgattactattgttatcatcactttccagatgaggacactgaagtcagagaaagtaacttacctaaggacacctaacttatctaaggacacctaacaagtcatgtactaacatgacttgggccgagatctgcacccaagttgatttgactccactataccccattggccatctgacagaaacaaggatctggggtacatgtatgtggctgtggctaagaggcagtcttcacccccatccactgtatggatatggtgcccacaggaaaggaggaaagggtgagaggagaggcagctgcgaaagaggaaggagatgctttcactgcttggcaggggccaggggtttatgaagatgctgagaaaggaacacctaactctcaaacaaaatgagatcactgctaggtaaggtggcttgccagcactttgggaggccgaggcaggatgattgcttgagcccaggagatccagaccagcctgggcaacataaggaggaccccatctctatgaaataaaaaaaatatgaaaattagttgggtgtgctggtgcgtgcctgtagtcccagttactccgaaggctgaagagggaggattgcttgcgcctaggaggttgaggctgcagtgagccatgattgcactgctgcactccagcctgggtgacacaatgagatcttgtctggaaaagagagagagagagagagagaaagagaccaggcgtggtggctcacacctagagtcccagcactttgggaggcccaggtgggcagatcacttgagcctaggaatttgagaccagcctgggcaacatggggaaaccccatctctacaaaaaatacaaaaattagccgggtgtggtggtgcatgcctgtagtcccagctactcgggaggccaaggtgggaggatcacctgagcctggggaagttgaggctgcaatgagccgagatcatgccactgcactccaacctgggtgactgagcgagaccatgtctgattttttaaaattaattaattaatttatttatttatttttgagacagagtcttgctctgtcgcccaggctggagtgcagtggcgccatctcgactcactgcaagctccgcctcccaggttcacgccattctcctgtctcagcctcccgagtagctgggactacaggcgtccaccaccacgcccagctaattttttgtattttttagtagagacagggtttcaccgcgttagccaggatggtctcgatctcctgaccttgtgatccacctgcctcggcctcccaaagtgctgggattacaggcgtgagccaccgcgcccggcgattttttttttttttttaatgagatcatttcatgtgtttagggagcctgcctgctgtgatcttcctttctgatggttctgaggccacaccactggttcttctattttctgctgcgagcagcctgcttcctggctcccctctcacgacagacacgtctgcaaagaactcagggtggggtttacaaagagctggaagggagcagtgcctgcagtttaaattcggagcctccaaataaaagcttcaaggctcccaatagtgttggaaagacagaggaggtctccagcagagagggccctcctggcagttccggcaatttgggcggcatacgcaattatgaagccaaagaaaagccaaatggccaacctcactcagcctcaaacacctcacacactcccacccgtgttcctgctagtggcaggtatttttagagtcctgagctcatggtgttaaagcatctgccacatgcctgagggctggtagggattcagacttcttcagaggcaaaaggcaagagtgaagactcctggggggtggggggagtggggatcaggagccaagtggtaatgatattcctgggctatgcctgctgtcttcctactgacctccattcctcctgtggtctgctctccctttcttcctgttcggaacaccacggagaggtggaagaaatgaaaatattttctgtctcttgcttgcagaagcaaatcagtctttgaggacttatgttttttctgtgtgatcacagtcagacgttctctctgaaatccccttggcacatatctaggatgccagactgcttgtagttttagtggttcaggccatcactgccttttgataatgtgtctgctgctgataatgatgatgatgacaacctcagtgacgagtgtggtctgatgcagaaaaagactgcttacagtcttgctggagagatgccaagagcactgacgagacaattagaaaacataaatctattcaaaatggtatgatgcagactcaaagtgcaacagagattcctaagaaaagagaattgaagggaagttggcgaaggtttgaggaagaagcctgaggcgtgagcttaaccttgaagaatgggtgagatttggatagggcaatgagggggcagctgattctataggggaggagtggactagcatgacccaaagtacagaggagggaatcaaccaggtgtagctgagtagtttgaaaccaggttgggaagggtcaaattatggcagacagaattccacatgtggaatccatgtgatgccacatacagtagagggctgcagtcgtttcctgaagaggtgaatggcatgctgatacaagcagggattgactaaagctagtcagaaagccagtattcagagatcgggcactggggctcacgcctgtaatcccagcactttcaggggctgaggcaggtggatcggcagtgattgggcctcccaacatgctgggattacaggagtgagccactatactcagactccaatttatttttatttatttattttttattttgagatggagtttagctctgttgcccaggctggagtgctgtggcaccatctcggctcactgcaagctccgtcttccgggctcatgccattctctggcctcagcctcccgagtagctgggactacaggcacctgccaccacacccagctaatttttttatattttttggtagagacggggtttaactgtgttagccagtatggtctcgatctcctgatctcgtgatccgcccgcctcagcctcccaaaatgctgggattacaggcgtgagccactgcgccctggcctccaatttatttttaagttcacttttttgttacctaaggtcaggagtttgagaccagcctggccaacacggcaaaaccccatctctactaaaaatacaaaaattagccaggcgcagtggcacacgcctgttatcccagctacttgggaggctgaggcaggagaatcgcttgaacctgggaggtggaggttgcagtgagctgagattgcaccactgcactccagcctgggcaacagagcaacagtccatctcaaaaaaaaaaaaaaaaaaaaaaaaaaagcaagcaagcgagcagtgttcaggagaccctgcaatggaaacatccacaatccaaaatactttgctctagtccaggagtgaggagaggagaggctggccgagggccgagggacacagaaatcagaatagaagaagggttcaatctgaaggtcttgccagaggaacttggaagctgtgtcaatagagggagatgacggggagcctggacaatgaaaactgatattcggaatgatgactctagggccctgtaaaatcttcactcagccgacagattcaattatatttactagattatacttactgactgctaactccaaataaaggctatacttcgttttaagagccatagcagtcaattagtggccataatcaaattttctttgataactgagaattgtatagggccttgggaccatcattctgagcatgaatctcccttgtccaagacgttggatatataaagggaaatagattgggctgaatgtatatctcctgggagttatgtctttgcatatgttacagatagcagctttttcttcataatttggcctttatcccaaaagctgagatacagaagaaaaatccagtgaattaagttccttttacataaccaaaaagtgaacttaaaaataaattggaggctgggcatggtggctcacgcctgtaatcccagcactttgggaggctcgatcatttgaggtcaggaattcaagactagcctggccaacatggtgaaaccccatctctactaaaaatacaaaaattagctgggcatggtggcgcacgactgtaatcccagctcctcagaaggctgaagtggtagaatctcttgaacccaggatgtggaggttgcagtgagctgagatcacaccactgcactccagcctgggcgacagaacaagactctcatctcaaaataataaataaataaataaatagggcttgaaggtgagattttaatactaactttgttttctttaaaaagttattcaggctagtggctcatgcctgtaatcccagcacattttgaggccgaggcaggaggattgcttgaggccaagagttcgagactagcctaggcaacataacaagattctgtctctacaaaaaaaaaaaaaaaaaaatatatatatatatatatatatatacacatatatataacatatatacacacaatatatataacatatatatgtaatatatataacatatacactatatataacatatatgtaatatatataacatatatatgcatacttgtagaagaaaatatggaaaaatatttaaaaagaagaaaataaatatcactatagtctcattgctgataaataaccattaatgttctgatgtgtacacttccagtctgtgctttgcatatgtttatgtttaacgtttcttaaaaaaaactgggaccatagcatatgaaaacttttgaggctgggcgtggtggctcatgcctgtaatcccagctctttgggaagccgaggcaggcggatcacctgagatcgggagttcaagaccagcctgaccaacatggagaaactccgtctctactaaaaatataaaattagccgggcgtggtggcacatgcctgtaatgccagctactcaggagtctgaggtgggagaattgcttgaacccaggtggcagaggttgcagtgagccgagatcgtgccatttcactctagcctgggcaacaggaacgaaattctgtctcaaaaaaaaaataaaagaaaagaaaaaagaaaaattctgtattctgcattttcacttacttgtattttgtgagcgtttctcttacaatttagtctttgaaaacattatttttaatggctgcataatatcccactgtacggatatattttcatttttgtttattctttttgagacggagtctcactgtgttgcccaggctgaagtgcagtggcccgatctcggcttactgcaaccaccgcctcccgggttcaagcaattcttgtgtctcagcctcccgagtagctgggactataggtacacaccaccaggcctggctaattttttttgtatttctagtagagatgggatttcaccatgttggccaggctggtctcgaactcctgacctcagatgatccacctgcctcagcctcccaaagtgctgggattacaggcatgagccactgtacctgaccccactgtatagacatgaactttagctattccttttctgatgagcatttaggtttttcctgttttaaaaaaattctcagtggctcaagccagtaatcccagcactttgggaggctgaggcaggcggatcacgaggtgaggagatcgagaccatcctggctaacacagtgaaaccccatctctactaaaaatacaaaaaattatccaggcgtggtggcgggcacctgtggtcccagctacttgggaggctgaggcaggagaatggcgtgaacctgggaggcggagcttgcagtgagccgagatggcgccactgcaccccagcctgggtgacagagcgagacacggtctcaaaaaaaaaaattctaaataacactgtaagatattagtacagaattttgaccacatccctatttcttttgtatagatttctggaagtgagatttcaggtcctaagagttatgaacatttttgaggttcttgataatattgccaaattgctctccagaaaagttgaccaatttacatccagtttttcaactaaaaatcttaagatttttttcaactcaagattttcagttaacaatcttaagaaaaacttgacaaatcctgaaacttctctttatgctttgataagtccattctgctcatctgtcaaagaaccacttcctgtgtcacggcttgtcactttttttattttttttgaaatggagttttgctctttttgcccaggctggagtgcaatggcgtgatctcggctcactgcaacctccgactccctggttcaagcaattctcttgcctcagcctcccccgtagctgggattacaggcatgcaccaccatgcccggctaattttgtatttttagtagagttgaggtttctccatgttggtcaggctggtctcaaattcctgacctcaggtgatctgcccgcctcagcttcccaaagtgctgggattataggcgtgagccaccgcacccgtcctgtcacttcatttttatagtgctacagaaccatgttttctcctctctgttcatgttcccttttctgactccacctttgggtttttgtatcttccaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 3701 - DNA, 1192 bp, human
tgaacccacagctcctctgcccctggcccatgagaatttcagctggagagatagcatgccctggtaagtgaagtcctgccacttcgagacatggaatcatctttctcatttggagtgatccttgctgtcctggcctccctcatcattgctactaacacactagtggctgtggctgtgctgctgttgatccacaagaatgatggtgtcagtctctgcttcaccttgaatctggctgtggctgacaccttgattggtgtggccatctctggcctactcacagaccagctctccagcccttctcggcccacacagaagaccctgtgcagcctgcggatggcatttgtcacttcctccgcagctgcctctgtcctcacggtcatgctgatcacctttgacaggtaccttgccatcaagcagcccttccgctacttgaagatcatgagtgggttcgtggccggggcctgcattgccgggctgtggttagtgtcttacctcattggcttcctcccactcggaatccccatgttccagcagactgcctacaaagggcagtgcagcttctttgctgtatttcaccctcacttcgtgctgaccctctcctgcgttggcttcttcccagccatgctcctctttgtcttcttctactgcgacatgctcaagattgcctccatgcacagccagcagattcgaaagatggaacatgcaggagccatggctggaggttatcgatccccacggactcccagcgacttcaaagctctccgtactgtgtctgttctcattgggagctttgctctatcctggacccccttccttatcactggcattgtgcaggtggcctgccaggagtgtcacctctacctagtgctggaacggtacctgtggctgctcggcgtgggcaactccctgctcaacccactcatctatgcctattggcagaaggaggtgcgactgcagctctaccacatggccctaggagtgaagaaggtgctcacctcattcctcctctttctctcggccaggaattgtggcccagagaggcccagggaaagttcctgtcacatcgtcactatctccagctcagagtttgatggctaagacggtaagggcagagaagtttcaaagtgcctttctcctccccactctggagccccaactagatcagcaggagctagggggatgagagcacttg

SEQ ID NO: 3702 - DNA, 41677 bp, human
agacacacagctcctgtcctgggaagctgattctgagggcgggaccctgcccctaccccagggagcccagagtctgaggggagacgccatctcagccctggtgagccccaaatctgagagggagggaaggtccttgtcccccagccccaccccaggagcccttgatcgggcacataaaagcaggcctgcccccaaaggctggaatttgaaggcgaggtagcgcacctgtcccagggagcctcagatctgagagcgagacagtatcccaggctctagaaaactccacgatttagcggagcgttatctcagccctcaagaggcctagtctaagcgggaagcagtgtgttccccaggatccctgaatctaaaggggagatgctgtctcagcccttggggaccctcccacccccacccttaacccctctcttagggcaggcatcacctcagccccgagtagctccaagtctgatttaaatcactggtccgttctagaggaccaagaatgtgagcaggaaaaacgattttgccgcctcccccaagaagtcccatatctgagagtaatcttacttcccttctcctgcgaattccgcagcgaagagggagatgctctcctgcctgggaacctttgtactgagggggttgatcatcaactgagataaaagaacccagtgtcaagtatgtataaacgtggggtgccccccagttgctgccgacttacagattccactgccaatgcttttgctcagggcactgatatgggagggggacccacatttatttttagaaagaatttgatatttgatatttcaatggagggtggtactgtgttggattttcttacacttcttttatggctttgtatttttacgttttaaatacatatggaagcacgtgccataatgggttcagtgtttggggcctctggtggtggtaaaaagagccctgccccccaaatcctggggtagaagcagccaccagagatggaccacattaggcaggaagggcttctaaacgaaatttcctttttacttcaagcccaggggcccaaattaatttctctcccaattcgccagtggtagctccacagacgtgactctgtgccttgtttttctccactgggagaatggggctctgttgatcaaaatgctagtgaggaggtagaaagaaatatggaaaatctccttccaacagttcgattgcaggccagaggagtggaagcctcaatcactgggtccactggggagagcagttattatatttgctttgctaaccactgatattagtattaatgcggcaaaaggggtgcataaaatggaaaaattgcctgtactttgctgtacaattcttagcaaagcagagctatcttcagagtttaaaggccctccacttgttttccttcctttctgggaaaaatggtacctctctgcctttgtaccaacttctaaatcattttgattttctctgttttctaaaagcaatcacagacaacaaacactcaccagacctgctcttttaccgatttcttctttacgaatacttagtcatccaagccaaacaagcctaacatctagaaatgtccagtttcaggccctggatattgaaatctcagccttacctcttcccatgagcttatccagcaccagcttttgaaatggcctcaatgggttccttttttttccaactgaatgagctttttttgggctccctcatggcacaaaatctgcctgcttggtccaatcccagagtcctcggaaactgaaattgctctgcttccaaggcagctctacatgaggtacaaacccatgacagccgtccttctttgttgcctttttctcaagaggtataatgtaataaaggaacaaagctacagaaactcacaaacctagattggaagctcaattctgctatgttctagccatgtaatcttgggagggttatttaatctctctgaagcttagtttcctcccctgtaaaatggggatattaatagctatgaaaaagctccaggtggaccaaagcatctactcttttgggaaaaaagagaagaggaaatacagaggtcagaattctttaaaaaattgatttagtaactaagttagcagttctgccctgtcccttttctttgaccacctgcctactctgccacttaattacttagtgttacattacctttgaaaatctttatccttaactaaatttcctggggtagaagggcataatagacataatagggaaatgcattcatccatcaatccattaattcatacaacaaatatttttcaaatgtcctctaggtgccagatattgagctatgcaaataatgttgattcactcaatgaattattatgcaattatttttaagtgtataattcagaagcttatatgataaactgaaaatacgcgtatgatatttttaaatgaaaaaaaggcaggatgcaaaatgtgcacacattgtaatatagacagcgcaaataaataataagcctatatacagaaaaaaaaaggctaaaaggaaacgcaccagaatctgagtcgtgattgtatttaggtaatgcaattatgggcaatttttaactgttttattattttcatatcttagtattctccaatttttctttaataaacctatattattttctggagttagaaaatcctacttagaaaaaaatctacaacttcgtctctgctgaataaaggactaggctagataggagaatgacgagggcctttaggttggggttgtgccagtggcacagggcacctgggctggctttggtgacccagaaaaggctgagaaagttggcctgcgagtaaaacgcagaattcccctcctgtgcaggggcacataacaagttatgactcctcctttctgaggatgtaggagtccttagtgcccccatcgagcagccaggagcctgctagcctggacctgtaatccctcatcccacggtatgtgctcacaagggatacataggacatccttgtcctcactctgacagtccaagacctacggcacgacagtttactgcttcttaagcgtcttctattgtaattccaattaagagccaagcatcctgctcctagtttgggtcattgtcttcccagaggtctttagccagaatgataaagtgaatctggggcttgttgacttttagaagataggcttcagaccttcttaacttttttcctgaagcccaaaagtgcttgacacccgggcatataattgctaattaaatgggactctaggaattaaaggcccttaaaccttgttgttgatcagtgtttcccaaagtacaatctattggaccagatgcatcagaatcacttggaatgtcatataacaatgcagatttcctgctcccactccagtcctactaaacaagaatttctgggcatggggactagaaaatagtatttttaacaggccctccatggtggttttacgcccactaaagttagagaaactctaatatagaagaaagaagtctttccctgcaaaccctccccttgcaccctagctacagggaacactgcggcaccctagccacaagaaacactggggcaaccaaatggggaaactggtcactttaagcccactctacttcttttgggtgcatggggaaatatgtagcatggaaaattgactaaaccttgaaacttgactcttcataaggcctaggtgtattcaaaatgagcatactccatacaagtcattcatttggattttctaagaatccttgtgtatatgtctacatagcacttcccagtcaggttatttcatttgaacattctacttgttgggttccttgcatcaggcaagagagcacagtggaaagggcagttaaaatgccaagagtgaggctggacttactggctgactggctgggtgaatgtgtgtctgcttcccaacatgagcctcaggctcctcctccatgaagtgggaatctcagtcctgccacccacctccctttacagcaggcttgtccaacccatggcccgtgggccacatgcaaccaggacagctttggatgcggcccaacacaaatttgtaaactttcttaaaacataagattcttttgccatttgttttaccttatcagctatcattagtgttagtgtattttatgtatggcccaacaattctcccaaagtggcccagggaagccaaaaaaattggacacctctgctctacagattgttaggaaggtctctgcattttcaggaacgagataacaaagtacttatttctgggtccatgaagggaattggcagattagcaccctgccccccagcatctccttttgagaagccctatcagaaggtccacacagagcacacagggatcatatttgctctctaaaggggactccaagccccaggacctcaagaccctgcctccctggttttctatttgtgaaagacttagctgggcaaatggtaaacatgtcagtgaaatcatgggtgctttgggggaccacttcgaacctcagaagggcctcagtttcctcatttctcaaatgggtttatacagagaaatcttgaagttcctttctagctacttaacagcatttctaggggtacactccttccatagcacttttttcccatagctctattaattctaaattttcatatcactgaaacctgacaaagtcctggcaccatctttgtgaggtagatatgggagagaattattcccattttcttagatttagaaaagtgaggcaaagtaagtgactatcccaaagtcacccaggggagaagagatgagctgagaccagcctccacatctctcgccccctgcccattcttttccggtactccttgctagatcccaggagctgtctgtcagtgtgctgacaccactcaggaaatgcaggtttcatcctgacaccagaaagacagagcaacgattacgcttcagtccccaaggaggcagagaaattgcttttagttgacaagcgcatctcccacacacatacccctctggttgaatgaaaagataaaatcaagttaaaaatcccaaatgctcacttaattttgtaaagcattttgctctttgagctaggggtaggcaggatgaaagaattttccaactccagaagtctcaacagggtggggtagggagaatagtgggaacaaaggggggcacaggaaaaaatgtcagaaagaacaaaaagcacagggatgttttctttcagttttgtgcgccataatcaataagaaaatggagttatctgaaaaaagaactagaaaaaattcaggtgtgtgcttatgcctttgaaaaactacaagacatgcaagccactgacatttccattctagaagaaaattctgtggcttccaataacaagagtttaggggctcagcagggggaccgtccacttctatgtgttaccatggactcatgggctttactacctctgaagttcatctctgcaaagcacttgcctttatatatttaagtgtagcagctcccaacgtactctcatatgtattttcaatctgaattgcatacagctttgggaggttggcaggacagagattagcacaaccctcattttatagaggaagaaattaaagtttgaggaaggggagtgacttgcctaaagtcactgccttttttgtttgtttggaacctgttcttgaagcacttttgtgcttccttcttttgtacatggctccctctcacactacccatatccagcctaaaatctggtctttagatcttatatgtctcttgacccctcccttggactccaaaaactggagactttcaccttgctgagaattccaaaccccctagaaagcctgagaaactccccagctaagaacattttattcttatgagatgcattctgaagtatttaggagtgaaatgtcatgatatctgcaacatattttcaagtatatatatatatatgactctctctttctctctccctttatctatatatatatatatatatagatagagataatttattgtgctattatgtatacacacacacacacacacacacacacacacacaagtataagttaaggagaatctcctcccaggcagccaccccactggtctacgctaaaatctgagtgttagtggtgcatgcatctcatggggctctacctcaggaccctatcaggatgacccagccccaaacacagaactagctctgcaggaggggaaggctacacctgtgagtggttgtgatgtcttagatggagcttgggtgctggtaagtggctgcctgtactgcatgggagtttagggtgaaggatttgatggtaaagcagcttaaattagagcctgagaggagtccttaaacaaattctaattagagctggcaattttccaaaaataattttttctttaatttcaaaacttgcttatcagggttgaaagtgccattagagataatctagtccaacctcttcacatcacgggggctggtgggaaggggacactgagatccagaaagggaaagtgacttacccaacatcatctagcaagttagtggctgaaaagggactaaaagccaggtgtccagcatcctagtccagggctcggtccattacatcatgctgctatcccactttggcttcctgggttcttgaaaggtcatctgcccaccccagggcttgctttcttcagaccagcgtggcacttgggggatttgcagtcagtgacagtccctgctgctgggagcagagccgggcgcctgaagatggcacctgtcacatcccactggaatgaattacctccctctgaaactgagagggccaggcggaatctgggagcggcaccttgagagcagagtcagtcctggcccacgcggctagcgtgccatggacattcaaggcagagaaggtaatggaaaatatcctgagcactgtttgctggggagctttccacctctcttggaccccaagtgatttattgattattttaggggcagccactctggtttattggtttatctgccattactcgtgagggggcggggtgggggggctgcctgcccgttgcgtaccctggtctgtcttctcacaggattggttcatgggacagcttagctggaccctcgtgagtctgtcgggattaatggcatttgactgtagatcatgagaaatcacatcagttgctgtgggtggaggtggatggagcaagcaggaggagggcagaggagaagaaggaagatgagcaatagcgggagggaagaaaaaggacgagggagaagggggagaggaaagtgcaataaaagaattctcttgtacaacaaccgctgacatttctgagcctgtagcttccctcgcttttaatcattcccttcattaagtgccatttgtcaatgcaaataggtctttctccattataactcaatcctgggacaacccacaccttaaacaaagatgcaaggctagctccagagccctaggtttccctaactaaggggctgtttgcccttccctccctgtattcctccatcccaggagccataagattggtatgtgaacaccaaaattgaccctgggacaaaagataccaaggactgactttaacttctgagctactttgggtctggcccccacccaaggaccccctctcctgacttctgtggcccaaaaccctctcctgctttcaagcacccagggcttataaccgtcctgctgttccaccccccagatcccaggagagttatgagattgaaaactaagcggtaaggcaggaaggtgccatcagagatgcatctgcctatgaccagagagcagccatgctggagaagaggggctgtagctgaggctgggtcaagtggcaggacggccatttgacgcatttggcaggctgtgcacacatgttgaagaggggaagaccaggttatattcagaaagcccttccttttgcccctaataaggaaatttctggccagatcacaggactctgggtccctagtgccttagcaaataacaggaacatttaagtctctgagtgactgtggaccctgacttcatttttaagattggctctggggtggcaatttcagtgacagggaaggaagagattgtgtaacatggatataggtcatggactgtaggccctcctcactgggccaggctctggggccttgtatcctgggactggggctacagctctctgccatctccctagggaaagagccgccagtatattctccaaatcacacaccttgctgtcctcagagacagtccctcaaatctactcagtgatcatgagatgccctgaaagttatggggtcaacagtggtgatattagtgcccaaggccaggttcaaggaccaagtgcagaacgtcggctcctctggcttttttgtcctttcctcccacctcaaaggaaaaaagggatcctctctggggttctcctcactagtgttctgaagctcggccccttctgctgctgccacctcagccaccaagaaacctctgaccctcttctaccttcagcctcttctcttccgctaactccttccttcctacacacatctcaaacctccccgtaaagcataatctctcccttagccttgttctacctgctcctgggtctgcaaaacttctcaaatgtgtagtgtctaccatcaactcactattttacctcttcccactccacttccactcttgaggccttcctaattctagatgcaatggctccttgtcaactctcagccctcttggctacttgacagccatttgctaccccatgatctctttctccttattaattgaaaactcctctgctctcagccaaacctcccaggtctcatctctcagaattcttcttctgtctgttcagtaatcctctctgtcatctacttattcatcttttctttccctgtgggcttcttcttccctgtagcccacaaaaacattgaaacgttcctatatggaaacagtcttccctcaacccggcgtccccttctagctatcatccatgcttcctttctcagccttagtccttaacaccttgaaagagtattctagatatgctcaccttacgtttccccaaacatacctgccatccacggcaagatggctcctaccccctccatacatgcacgtgcgtgcatgcacgtgcagacacacacagcccctctcaaagcagttacgaatgttttttttggaggcctgctccaaggggacacatctctgtcctattttgattttcattctctgcagaatgctacattgtaagtctctatttattgaaactcactcttcccttggctctgcggacactgctatactggtgttcttacctctgatttctccttctggctctgcattctcgtttggtaccctaaatgggagcattgctcaggtcctgtcctcaacgctctattcttatgtggaggggctcatctactctgatggcccttatctctctggatggctcacaatacctaaaatagtgtcctccatatagtagacacttaagtaatgtttacctaattgattaacgtttgttaattgcacaatgcctggtacatttcaaatgttctgtaaagactattatgggggattttacagtttacaagcatttcctgtatatttgcctgtcttcatcctcatcataaccctgtgaggataattttttcttattctcatttttatagatgagagaagaggagggagctaatgtttgttttctgcctattctgtgctaagtgcttaatacatattttaatttaattttcacaacagcactgtgaagtaggtgttcttagccacattatacagatgggaaaactgaagctcagaaaggaattcaagatcacaaggagcatataatttgcctcctctgctatttcattgttctgtaaatttgatcatacaaaatttagtgagcaatactggggaggcatataaaaggtatcatacagtgatattataattattgtttacatatgagtattttttggtttgcatttgtatgaaatttaatgtcatgcatataaaaagctgaagaggaaaataaaacccttctatttccaaacattctctgcctttctccctgcatattataataagaagaacagattattaaatgtttaccatgtgccaggcattatgtttagcattttacatgtgtgctttcatctaattctcaccacaacactatgaggtgggggctattattatatctcaatttatacataaggtaattgtgcctcataggagttaagtaactggttcaatgacccctagttagtttgtgaggtaactgaaattttaaatcaggttggtctgactccaaagtgaatattctttaagtgataccagactgcctttctaagaggatagggaaaccaagtctcagagagattgtgaggtcaaatctcctgactctacatttttttccagctgagatgcttcagctgctagcatctctttgttgaagggactgcttttattgtcaataatctttctatgtctgtggtctgtctcctcaaccacattgtcagctctgccaaacctctttagctcccctacagagggtcctcactaaatacttgtcaattgataagcatggggctctcttcagttgagagaattattaataaaccgtcaggctttgacaaagcccttctgatctccaaaggagttgagcccttggagcttaggagatgtatcaattcctcgccttcctgcagcttgaagtcaggagcccacactgcccgcctccgcacagcatccattctccagggagcctctatagcgtcagaatcatttcaccgaagactaaattatgtgtgtgactctgggagggtgaggtctccgtaaacggggagaagaatgtgggctgtgattctgcatgcagatggaccctggggatgtttcgcaccatctgagatgatgtgtcaacctctggcagtggcactccatagaacaagctttaaagattgatcattactgttattattgggaatattaatattatttttacattcgtacagtgaactcctgtttacgcaaaaggctcctgcacaagaattcatttttttcgtttgtgctggccttccacaaaatcttttgggcttcaatattcccccaaagaaatattcctctgtccagcttttgggaaagagaaccaccccagggaaacagaaacagctgagaccctgagaacgggaaccttagctggctgggactgaaggccaacaattgatcctgctgagcaatgaaatacatttggagcctgaacacaaatccccaatctccttccttctctttgcctgttcccagagctggcgggacctcccaccccaagcagaatccgtagttcctcccgcaatcagaattcactcttcctcgtcccttcccccatcaatggcctcagggacacttatgtggaagccaccaattatctcttcccctcctctagaccaattttctcatgcatttgtatgagttcacttagcatcctgcaaagagacaggcagtagtaataatcacagctaacattcatggagcttttactataaggaaggcactataataagcactttgcatgcataatttctcttcattctcataatagtcctacgaggaaggtttatttggatccccactttaaagaggaggatctttaaagtagaatttctaagtgagtaagcagcctgcattagcctagctaatgcagagccaggattcaaagccagatctatgaacctctccagtatactgtctcttagtatcagcttccatttcttggatacaaacagtgggacccagagattggaaggccgtgtagcattcagaggaaagagtctcaggaagtcaggaaatagttttcctccaatttctgccagtaacaggctagatgagtctgggtgagtcactaaaattcccctttttctgaatctgcaagcagggtccacagtgtgtgagatgcaaaagatatgagccaaggaaggttaatctcttccaaatctatagagttttaaaaaagcaccatgcaaatgcaaagtgttccttatcataatccttaacattattattccagcctattcatctaccaatgaacctgggatagagtgcctggctctgcccctggattctggtgccatttaagtgccaagacaaatggtctcagggagtcaggggtgatccattatctggatatggattatttctcaggagtaaattgttagccctgtcaggtggctgatgaattctcccactgcacctgggggctcatcactctgcatgggacgtgcagggaatgcaagcagcgcagcagctggagtcgcagtgtgactctgcagatggggtcttgggggcggggaacaaggatgtgttggttaggttccagggagcagcaaacgaccccacccatccttgagtgaaaagacagataatgaaccccacccacccacagtccagcccagggcagaaaagagtaactccttcctcctcctgatgcttgaagcatctttggggagaacaaagcagaaaagaggctgacagattcatacacaaggagctactgacagagagatgagaagaatgggcaagagaaagagaaatagaaaaacaagacatggagaaagggataaaaaagacagggaaagaaaatgaataaaataaataaaggatcacagaaaagagacacatggaggaagaggaatacagttaaaagagaaacccagaaataggagctaagaggaaaagaagaaagagaaagaactagctgggtgcggtggctcacgcctgtaatcccagcactttggaaggcagaggtgggcagatcacttgagcccatgaattaaagaccagcctgggcaacatagcaagactctgtcaatataatttttctttaattagcaaggcatgttggcatgcacctatagttctagctactcaggagggtgaggcaagaggattgcttgagcccaagaggtcaaggctgcagcaagctatgatcatgccactgtgctccagcctgggtgacaaagtgaaacactgtcaaaaaaaaaaaaaaagcaaagaaagaaagaaagaaaaaagcagactcagaaagaatccccaaaaatgggaaaggtatatagagaaagaaaaaaataagaaaaggggaaatatatggggaaagacaaatctagagagaaaacaaataggggaagagaaaggggaagaaacaaataaaatagaaaagaaaagtatacagagaaacagaaaaatagaacaaccagagataaaggaacacagtgaaagaaaaagggatgagggagatatgaatactgggaaaaaaataggtgaaaaaagttaagaaacatagaagaggagattgaagtctttaggaggaccagaaacagttttttcctccctccctcccactttcactgttagccattcttgtgggataaaatcagtcagacacagacacacattctgaggcaaataagcacatgaaaaatagtacatctggacacagaggagctgaaagacttgagatgtaggcagcgacagactcacagtagagagagccaacctgaacacaagaatgggcctcaggcagaaactgacaaggaactagatataccactgcagaagatgacataaaggcatcttaaaagatggacacatgaatagacaggtacacaagcagatatccgccaggatgggaggaggaggtttggcctagctccgttcctcctctcttctctttgcctttgtgaaatactctaataatggacatttaccattctgggtctcctgcccttgggattttcctttaggctttgcgaaggttggtagcagtgtgtttcatttaaataaactcactcctgctagggtctgttagtcactgtgtctcccctcctaggaacacacgtctctcatcagtttaaatgatcatatccaaaagaccccttcaggcatgagtgtaaatggctgaatatcaggcccttggctaagacagagttgcagtctgtcttgacacttactccaagactggaactttttgcccctagtatgccacgatcctccttaactttactggaccttccttttcacctctgcagtttgaagcagttgagaaggggaggctatgcatcaggatccgcacccctacttgaataagatgaacgtcataagatttccttggttaaaaagtgtttcttgcgaaagcgaagcttgaaaacctcggggttacacagagccagatgaattctaagggtcctttcagctctgacattctgaaattctatgactaacagctaatttgttcgaatctaaacccgcagtaattgcacagaacttgattgaattttctgagcaaacggcgtcactgtctgccccaataagtatttagccatggccccagtttattgattttgtgcagtatcaatatttcttggtgcagtttccagcactgactggtaggtgcatgatgacgtgaaacatgtaggctcaagatgcccacccaggaaagccacaggtggttgtcgctgtgtccacctggcttgggctggcacacagactgcaccaacctctctggctagtgctgggcacatggaggggtagcacgactgcctttgaaaggggcatgctggttgggtgggtggatcgggttgccctaaaagctcagggatgctgtagccaacgggtcacaaagagaatagcagtgaatgggtcttgctttgtacaacttcactttgatacaaatcatccctgaaggctactgcctcacttagtatttcattcattcgttcattctacagagagtgcatactctgtgccaagctctgtgctagaactaagaatatagacatgaacaagatacagtccaatatctcccaagaatctcatttgtgaatcagaattgtggtacagtcaagggggcagtatgtgaaccaaagtcaagaaatattgatgccgctcagcatcaacaaacttaggctatggataaatatttatgagaagaaataatttcgtaggaatattactgtatatgcacacttttaattattcccactggcaaaactgatgaatcagagacctttttttgtatacagtattcaagatgcaaagaagtcgtataattagttcaggtaaaataacttgattgtttcctaagtacaactctgaaaaagtacaagttaatttaatactttttgtttatcttttagttacacattctccatgatagagttttatttgttggtgatggtttgagagcattgtattttggagagaattaaaacatttactggaagagaaaggaagattggttcctctctttgatgctgccatgacactaagcctgtcattcccaaacagagatacattcgtgtatgtttgtgagttctcttgatcatttgtcttttatatatctagactttcatacatgcaccaaccatacacaaagcaccttctctgatgcgtgcactgggccacgagtgggaacactggaaagattagagcatagcccctgcccttgaagggcttacgctccagaaggggagccaacaaataactcgaggactttatgatgagtggcataacagaggtgtggacaaagggaagctgagaagaacagggactaagagatgagggtatgtggagaagctttaagagacgagtggtctatggtggggagtgttggggaaggtctgaaggtcaaccctattcatcattgtggggctagacggagccatcctctttctccagactctgttttgttttgttttgttttaatcagtagaatgtatttgtgagaaccacagaactacactgcaagcagatcagtctgtagctgggattagcctggtagcctgcatcagttaactgcttcaatttaggatgaaatatagccactccttttgaaaaacacaatgcagggaggggggtggtcggagactggttcctatcccctaaacttagcttcttgaaaatcagattttccttacccacccagcactcctatgtagcagagttattcttttatgggggcaaagtggtttgagtagcactgggtatcatggtggctttcaaattactcacattccaaaggaggtttaatgatttccaagataattggttgtagaaataagtccttctaaaaacccagcaatagaatgttcatgatgccacaggatgattcagaacatttggccttaattactttgattgtccgccaggatttaatatatgaatattacattgcgatcttcaatttaatttcttgtgtaaatggattgtggcagaatcctgtagtcctgaactggcacataactcagcgtgggagacactatcttaactcatctcattactcaagccatttgttgtccttcaggctttgacagccaggagatgggaaagtagcagaggtgatgtgatctctcaacctgggtccagacagacatgagccatagtctctaccgattgcgttgttacacagacacagacagcacttattttcagaagaagaaaaaaatgcccccgccaatgtgcagctgtgtgctctggtctttcttagcataatggagtggaaaaagctggggcatgcatgcaagagacctgagttctagtcctaagttggccactaacttgcagtatgatggacaagccgcttaatttctctgagcttttgattcctcatcattagaactacataatctccaagcgctttccagagtgaaggttttctgacgtattaatagcacttggcaaatctgacagttttggcaccatggctaaaagaaggttgtttctatccatcctgtgaataataagcagccccccaagaatgggcaaaatttgagggaagggagagagagagacagggcagataagtgggagggaagaaggaagggaaggtggagagaacagccctgcagccttactgagctatccctcagggcccaggtgagcttgttagaaccttagcaaaatgggggacatttgagcctgggaagcttgatggaaattagaggaagaaaatgagactcaaaaagcattaaatgggaagccacagtgttggaaaatttatttgtaccacatataacagagagcttgcatctagaatgtataaagaactcctagaaatgaatatgaaaaggacaatctagtaggataaaatggacaaaagacttaaatgggaattgtacaaaagagtatatccaaaaggccaatgaacatatgaaaagatgctcaacctcattagtcaccagagaattgcaaatcaaaccacaatgagataccactgcacacccaccagagtgattaaaatgtaaaactctgacaatacttactgttaataatgatttggcacaatggaagagtgcaaattgatacaaactttgaaaaactggcagcatctagcaaatggaacacgtgcttacgactcagtgattccactactaacagaaatgcagggacatgtgcaccaaaagtcaaacaaaaataaccataatagtgttagtcaaacagtcccaaactgaaaatgcccatctgcagtagaatggttaactcagttgtggcatattcacaaaagggaatattatacagcattgagaaggaacaatatcagttttatgcaacaacatggattaatctcacaaacataatattgaatgaaagaagccagaaacaaaagcgtacatactgaattattacataaaagtcagtaactggcaaagctataatgtttagtgatgcatgctaaggtgtacaagtctaaataaaagcaaggaagtgatttttggaaaagtcagaaaagttgttaccttttagtaggggagaaaggagttatgattagggaaaggacacaagttgggcattggagtgctgataatattctatttttaactgggtaatgattaatatgggtgtttcattgaacaagttgtgcatttatgatttatgcacttttctttatgtgtggcatatttcacaatttaaaaaataaagctttaaaaatgcagagattgaaaaaagtcaaagctaaatctttgtttcagactaatgcaactccaattcctatccattctctcaggaccctgcagattctagacttttggcaaagagaggacgagagtttgtgtctcatttctctcagtatctgcctgtcacaatcttccaaatttaaagctaacctgaccccagttggtacctaacagccaccagccaattgactggagtcaaagacaccttgttcctgctactttctagttccctctcatttccccattctcaaactattcttgttccatttcagttccatctttctcctgagtctttattccgtcttctgtttgcagccctgttccttccttttggactaatggctgagtgacccaactggatttccttggcttgaacctgagcaagccctctctctctaaagacttgaatgcctactcccttcactgagtggtttcttctgttcctggccaactcaggtagggtatctaccacctccccatccctagatcttaaagggttaaagtgccttatctcaaatccttagggccagatgtttcgaaattaagaatttggggaattttatcaaggtaatcatgtgtatttgccaatatcacataacacctctagcaggttgcagtatagctccccattatcaaatacattaatatttttgtcatgaaatatatgaacattcacactaagtgggataaagaaagactattataatataagttaaactgagttttaatgtcaaacttatgagaacgtttttggttttcagagctttgtggtttgggaagtgaaaataagaaataggagcccaatgcttgtttggtggatggatggaaggatggaaacatagatgtacacaatgaattacatgtgtttatcatctcaagtgacaaatgtgcatttaacaagagtcttcatcactttaaccaattgtgggcacatcagaatccatcgctggcaagaggaacactaatagaaaaatccaccacataggtctgctaccagatcatggatggcctgcctggggttaagtggcaatccctgggccactcttctgcataaaacatccatccagccctttttcctggctatgagtgaggtaggcctaactagaagggaaagttatgggcatggcaggtacctggggctagtcttttgggtccagttggaaaggaatggatgggcttcaagcaccaatttcaggtggccctccttaaatagtattgctctcagcaaggctttgcaaaggtattgagtggaattagttcgagatcacccttcccagcaagtactcagagtgcagtaagtatatatttctaggaaagggtacagctaggtgtttttttacttccagccacctgggagtgtggatactatatagcttattgtcctgggatgcttcagaggcaaagcagtgagttccaggagaggctagcaagggactagaacagagtcaaagccaaaccttcaggcttcccaacccaggagacaccaaagagtcatgggagacctcatcaggagaaaaccacgcagttccaggaccgatgcctagaggagaagctcaggggaaggtggatttgaggagaggttaggaggctcagccttagagcttcaggaaactgggttgtttgctcctagaagatggaaactgagttaccagctaggcatctcccatagctctgccccaggcttttcaatcttaaaacaataagacaggacttacgtgagctctttcatctgtttctgctctgctttccagagctcataaatctatgattctcttttaaataatctttgtttttttttgtttgttttgttttgtttttattatactttaagttttagggtacatgtgcacattgtgcaggttagttacatatgtatacatgtgccatgctggtgcgctgcacccactaactcgtcatctagcattaggtatctctcccaatgctatccctcccccctccccccaccccaccttgtttttttctcataagagtaatacatgctccttgttgaaactttgaaaagtcaggtaaatatataaatatttagacttgcctatcatcccacccacctctcacacatttgcgtgtattacctttctgcttgcttgcttttattttccatgtctttataaaattgtgatcatagacttttgtattttgagttagacacttaagtatattgtgagcatttcccatgtcaccacaaaagctatcattctagtctaatttgaacatccatcagacattgtggggcacacttagcaaggataaaatgtgtaccctgcccttatggaacttatactcttgttgagaagatgaggttgatatatatggaaccaatagtgataaatacaaatggaatataatgaaatgtcactttgagggataggctggaaggacagtaagaagccaaaagagggaaagactgatgtgggcagcactagtaaggggaggctcctggagaaggcaggacttaaattggcctttaaaggataaggaaaaggggaatgagaaaggtagaagcatgaagaaaacagacacaatgggggaaagctggattgagtaatcccaaaccctttatacttatcattgttgttgataatacagagctacccagggccaggatttcaggactgttcagggtcccacctaatatatgaacaaataaacccaggtctctaacttaaaggggatttggaggctaaatgcatgaaaaacgaagcactggtattaatatggcagtagcttagactcagacctttttgcatttagtaactgacttgcttctctgctgcatcttgcacagtgatggctcaaacatcacagagtcaccagttggacaacttcctagctagatagcagattacatgactccagagccctggtcacagtcatctgactactgtgggttggtacaagaagagggtaaacagagagaaagcccatgtcacaagcccccttcttcatacactgaagacacagccaaaaacttgttgtaaatgttaattaagccattaatttgtgatctgaagatctccccagtgaggctaggagtttcgttaggacagaaaatcagtggtttgaaaaacagtagaaatgtacatgaaataccacagtttaagattcatttgggatgcatcagaaatgtccttgcctatggtcaggagacttgccactaactagctacatgattttgactaaattctattacttcttggagtccatctcagttttcttcctcatctgtaaaatgggaactatttcaaagttcccttttggcaccaaaattctatgaacctataatttctttggaccaccaccacttttcagatttcaggatcccctacaacaatgcaaataaccctaagaaaaagctacatcttaccctgtgttgccagtcaccaccatacctgggaatcgaagtcctttggggaatgggaccaggagagcaagcaggcccagccagaggggaaaggcacaaaaaggagaagttggtggaccccaagatgtcaccagttaagcagagagaggatcttgatacctcctcctctatctgcctgtcccctgagtgcccagcagcaggctgtgctttactgcatgcctacgtaggtgcctgctcaccacagggtgccctagctgccagcatgctattccaggccaataggagaaccctgaggtgaagtatcctggggccaatcataggtggaaatatctctttaatggcaagagagactgtatctttggctccttttcattggttcaggccaactgaaggctctctggactctcagccaatgccaagccatcagccaacaggaatgggctttgctgctggatcttgttttcgtctagggctgatgggtagccctgccccaagggctgccttgtctcttcattgtcatccctgactgaaaacttttgccatgaacacagaaggcatgagcagtgggacttaatcgagtcagctcagagagaggtaggcatgcttggggccaggggccatgcctgggcccagtccctgcaggtgagtgcaggtgaaccagcgaaggagacaataagcaagtagaattggtgggcatgggcactatgagattaaagctaagggctgatcctgaccgatcaaacccttccttcccacaagccatgagtatctgagtagcttgtccacaaccctatggttccctctttactctttctctgtagccccaaccacaaccagggaggggttcctcccaagaaagtaagagaagcttattggagaaggtgtgccggctcccacttgcaacctgcattccctgacttaggatgcccgcaatgatcagagatatagacttggtgactctggccttcagagatacatggattccataatattcacttctaacatctcagactatagtctgactatctcctcatatgctttaaggaagtctagggttgtgggttcgatcctgggtaagttggatagccttcttcactttggtctctgatcattgacacaattattagtcccacccaagggcaaaatctctaacctgaacagctatttaagcaatgtgtacacaggaggcagaatgagagagtatggagggtacagtgaaaagccttccctgtttctggaaacattcagtcttacatcaaacactcactgaatgccttttgtgaggcagacactcaactagatactaagataacaaaaaggaataagacacatgaacttttggtgaatcccaccagggcagagccaaagggaagagtgtgttttaagcactggtgatagactacctttaaaaatagacctgagattatagttggctttggaatcccccagacctagcccttggtaaaactggtcacaaatgtctgtttacaatgccccttaaggtgctcctctattaaaactttctttcagaaaaaaaactatacttcaaaatttatgtaagaccttgggcaagtcaattctcagtcctcccttccttaaaataacaagtttaggctcggggctgtgaagccctttccaaatctaatagatcatctaggcgtctgtagtagcagtcatttactcattagtataaatttaagtagctatgttccttctccctggattagctacattttaagctttgtttccaattgtggaatgaaagactttgtcacttaaaaatattgcagggatctgcctacaagagggaaaagaatttgtggaagggaaatgaagattaaagaggttataataaacctccccaatatcctaacatcctctttccttgggctctagggccctgcactctgttgaggttaatcccaacagattacttagttactaataaaaagaatcattaaaaataaaaaattaagccctcttgggggcttacaatgatctaacaccaagaaactgttccaacaatgaacctgaaaagcctagtgaaaagttctgaggacatattatacaggctcaggatgcaggaattgcaaacagcactttgccccttgctcttccctcctgttttggcttcctttggagcctagatctcagtcctactggccacagatattttgaatgattcaaggtcaggaaaggggaaaatgattcagaaatgcacatgattccttaagtacatttaattgtaaaatacatctaatcaatccgatcacctgtctgaacatggcagctaggagaagcaaagcaaagcttttgcgtttcactccaaaccaaagtaagaagctaaaggcggtagggggaagggataggatcaatgaatccaatcaatggtctatattaatgtttcttatatgatagtgctgatttgcagctttccaggtgccaaatggcatctgggaaacattactccatcccccaattgacgtaataattagattgcataaatggttcctctgcgctcaatgccagcccaagagacaaatgttattggtgagccaatcaatctttccccccgttaaagtttcaacctgcgtcagcaattatgctgtggaggtcgaaagccacccaaatgagtgaaaactggcaaagatgaatttcaggagtggattatactgcactgtttcccagcagagtgtgtatggtcagaaaccggacaggtacatgaacagatctgcagctggatataccaccaggggccagaagaggaaagaaagtctagtggcatcttctgcaaaattttgcttttctctattccagttgtctccttcatacttagataaaccaaggggctgaggagagtatgtcaggggaaggcattagtaatttgttattagtctttgtgttaggctgaataatgctccccctcccataaaatccacattctattcccaagaacatgtgaatattatcttctatgagactttgcagatgtgattaaattaagcatcttgatatagacagattatcttggactagccagctgggccctaaatgcaatcacaagtgcccttataagtgtgtcagagagagattgcagacagaagaagagaaggcaatgtgaccatggaggcagtgattggagtggcgtggccaccagccaaagaatgccagcaaccatcagaagtgggaaggggcaaaagatgcattctcccctagagcctccaaagggagctcagccctgccagcaccttgatcttggctcaggaaacatatcggacttttggcctccggactttgagataataaatttctattgtgttaagccataaaatttgtgatcgtttgttacagcagccctaggaaactaatatagatctccattactaagcccaggtcataggtagaatgataaacaaccttcctgttgtattgtaaagagcatcaaaatcctcctctagccaaaataggccctcaatctatcatgatgcaatgtcaaggactaggaatccaaaattcacacatatatgtcaacatttctactttttgagcaattctttcttgctactacattgcaaacagtacacataagcccttgttttccattagtccttttgcatgaatttatgcatccaattaactccagccaccaggcaagccttggagggacagggagggacactgagcaggtagggaaatacagtaaatatgtctaaattgaaaccacaattgggctcaaatcaaatcttttttagtaataacactaagtagggcctttaggaaaacaagtcatggcagaactaacttaatttactcttctgataaggttacaaggcttgtagatcaggagaatgctgtagacaggatgcatctggattttaacaaggcttttgacttagactctcatgagccttttatagataaagtgaagaaatacagactgcaggtgagacaccagaggtagcaggtggctgctgatatgtggatcagtgtctctagtgataggtcacagatctttacatcagtgtcagtcaagtcaccattcttatccaacagctcagacagatggcatgctctctgagagtgaggatgctgggaagctagaggatctagctaacagattggatgggagactcaggatccaaaacaatctcagtaggctggagcatgggctgacctctgtgaaatgcaatgtccagcattaggaattcaaaattcacatgtacaaagacaggcttatatacagagcagccgtcagcatacagaaggcagaggagatcagtaggcagacagctggatgagtcagaagaatggtgaggctggcaaaaataaaaaaatttaaacaataaaagctaaatgtagctgaatgtgcctctctggaaacaagagagaaccgtgctaacacttgattattttccattatccaggccatactgggttccattctgggcaaaattccttttatctccctgatgtgtgttatctttaaaaaataaataaaaacaaaaggtggaggggaaatggagagatgttggtcaaaggatataaagtttcagttaggaagaagaaattctggagatctattctacagcatagtgactacagttattaataatgtatacttgaaaattgctaagagtatatcttaaatattctcaccacacacacatactaactatgtgaggtaatggatatgttaaatagcttgattcaatcatttcacaatgtaggcatatatcaaaatgtcacattgtacattgtaaatatatacaattttgtttgtcaattacctcttaataaagctggggagaaaaatacaaaaaaaacttaccaaagtatgtaaagtgaaaattgacagcgttcctccctcccagtacctaaccccaaaggtaatcactgttaacagaatactgagtatccttccacacttatctttgaaattatttatgatgtacaatttattaacacaaatgaaagcaagctatatgtattgttcttggccttgcttttgatttaacaatatatcatgggcattttcccatgtcagtgatcataagagctaataattactgtacactttccacgtaccaaatacaattctataaatacttcatattttcattcagttaaaactcataataacttccatgagatgaagactattgttattattcccactgtagagaaaagaaaacagctcagaggactttcctaagattacagttatttaatggcagaggttggatttgagttcaggtctatctggtgccagaatctatgctcttaacatctacaccaagctgcctgttagttctttgagggctacctcattttaaaaaaatacagtataggagtttattgtatgtgtatcataatttaattaatcttatgttagtggacataagattgttctgttactgaaagatttttcagagcttttaatatgctaatgtgcattatgaacctcttcagaggtggatatagtaggcaatgtgttcgaaacttccctaaccatggcatcttttttttctcacagagtacttgagagactggagcattggggatcagattttggtgtgcatctgcatcatctgggatacttttcaaatgcagacccccaggcctcgactaaagtgcttctgatatggataatttatagatcacacattgagaaatactgctgtgtgctatgggattaatatttgatgtataaaatgaatatgagtagctacataaccacagttttattgatcaaagacatgagtagctgggagagagaaacactcttttcccttccctcctcaggtcacctaatcatcagaaccttattcactccaatgtcagaaacccacatcaaggatgcattgatctggcatccccagtgagctaagttcccaggagactaagccaccagtaaccatcacacctctccacctccctcaatgaagaacttgccactactgaaagtataagataataatagattaaaatccattaatcagtaagttaatattccatgcatattctaactcttactattgggatctctttttttcagtttctctcatctacagatacattaagaatagtcagtttcttttctttctttctttcttttcttttctttctttctttctttcttttcttttctttctttctttctttttctttctttctttttttttttctctgagacacagtttctctcttgttgcccagactggagtgctatggtgtgatctcagctcaccagaacctttgcctcctgggttcaagcaattctcctgcctcagcctcctgagtagctgggattgcaggcatgcaccaccacgcctggctaattttgtatttttagtagagacagggtttctccatgttggtcaggctggtctcgaactcccaacctcaggtgatccacccgcctcggcctcccaaagtgctgggactacaggtgtgagccaccacgcccagcctaagaatagtcagtttgtaacacaaacatctgcagaacaagaattaacccaatagcgacaaaaacaaatatgagagaataaatgttattatgtgttttttaaactatgagtttggaaaagtacaagatgtcctgcttgtgctctcaagttatatttaatatcatcaaatcccactcaccattgcaggttattgcttaagggtcacttgaggtcgaagtggagacaggagagaaaggacaaagggggaaaggatgagagggtgaagacatagccagactgctcaaaggagtgcttagcagggaggctcctggaaacattcatctccagtgagtggacaggggcgcttacttgagaaggagccagagtaggctattgctgttcaaccccaaaccctgcacttgagaccccctccacaaatcacatgctgagatttccaaaatacccttgcccttagaatctcaaaggattctcacttcagctgcaagaagccaagggggcattactacacaccctatttgacaagtggggctttaaaggctacagaagtttggaagaggcaatgcctagtgtagaaaaggaaaccaacagatcatgatgcagtggaaagtatactggaatttataaatttacatttagcagaatctcaagcatgtcaaattgcatagaaaaaaagctggaaggaaatatggacccaatattgatcattatggatgactgacgttttcttcttcatacgtgtctgggttttcctctcctctcaaacattttacaatgggctttactggttttatacacaataaaaaaggtaaatactaaagaaaaatagggcatcagcctaaaattcatgttccatctctgctcctctcactctctgagactcagtttctacaaccatcctcagggaactgagattggatggagatattgactgagagaaagggaaagaaaagaaatggaaggaaagggaagagaaagaaaacaaagggaaggaaaagggaagagaagagaaaggaagggaaggaaaggtcaagactaagatggtggtctagttgaagttatcttggaaaaggagatactgttctctgacctcagagatggtggctatgataatgctttgcaaattgtcaagagctattatgcaaatgacaagactcattgctcttaaagacccctgctccccatcggacatatgtgtgcatgcatgcatgcacacacacacacacaccccttccctaaactgcttgaacatttacactttggctcaattttctcttccatttcggcgatctcattaccaattccaggcagagtctgttctctgcttgccactagccaatctagctaccttggattccccagcgtaactgagtttttccccctatagactgttgtcattaacaagtgtcatctacataacccaaagccatgtcccagagctctgcaagagccagcatagtgactaaaaatgcagcctggtccaaccaggacaggatctacatttccttctttcaagccatattaattacctcactatgataattcctcacctatgcccagagtctatggtttgcaaagaagctgtatattccgtatctttctggggcctcacagcagtattggaagggaggcaagtcagagatggacactcctgtttacagaacacagagagggcaagtgacctgttctagaatcacagagagtgagtaaaagatagtatcagaattcaaatccaactttatcccatacccaagccaggctctttctcctataacatagcattagcttacagttggatatggagaaaggaaaacacagaaaatgagtaactatgcacatgaccattgagagattcaacatgacatggttgcaaaacctttttcttactggaataagacaagatccacgacttgtaataagactccatttggaatctggaagccagataagagaaagttctctgtctgagattatcactgggctcttccacgaatcatttcttcattcatttcttcattcatttattcagtatataagcatttattaaatatttcatatgcgccaggcactgtgcttagtgctgatggataagatataaagaaaggcaggatatggtccagagcctcaaggaattcatcatggtctaagagggaggaatttaaaacagacatggctaattccaaatacatagcaaagtaggattcatgccatgaaagagtaaaatgctctggtagcctagagaaaagattcagatctgtttgctgtttgggggatgtgggatgacttcatgctatatgaaactgaccaaggaaggatgagtagaatttgaagaaataggagctgggtgggtgtagggactgccaggaagagaacagcatgatataggcacagtggtaagaaaccagacggattagaagggaatcagtgaataattctattttgatggagctgggattggatacaagaaagaaaaagataagatgggaatatatatttgggccagatcatggtaagtttggaatactgtgggcccagcatcagtttccatccttctcagaggccagcagtggctgtgcaggaaggatttgaggaaggcacaaaggatggacgctgctccctcggatccacaggccaagggaaaaaatagtgatgcttacattggttccaaaagagggaaagccacactaagtctttttggcagggtagcaaataatggcaagttgctttcagagaaaatgtgctcaattttggttttttaaaattgtttttatatatttagggggtagaagtccagatttcttacatgcatatattgcctagtggtgaagtctgggcttttagtgtacccatccccccaaagagtaaacactgtagccaatacgtaatttttcaatcctcatccgtctcccactctcccaccttttgaagtctccaatgtctgttatttctccctgtatgttcatgtgtatccattgtttggctcccacttctaagtgagaacatgtggtatttgtctttctgatactgagctatttcacttaagataatagcccccagttccatccatcttcctgcaaaaaaacatgacttcattctttttatggctgggtagtattcgatggtgtatacatacaccacattttctttatccagtcatccgttgatggacatgtaggttgattctgtgactttgctattgtaactagtgctgtgataaacatgtgagtgcaggcattttaaaaaaataatgatttattttcatttcaggagaaacccagtagtaggattgctgaatcaaatggtagttctatttttagttctttgagaaatctccatgctggaaaatgctcaattttgttcactgaaattttggccttggcaccttccccagttcaccttctatgcctttacttgtgctaaactttaaacctgtagtgtcatcctcagcctatctcccatgaattccacttgttgaggatgcagattcattttgttcaaggtatttttcctgccctttgcttcagtggtcctcacttccccatagttaaagccactgatacctatttctgctcagtcttcttcctggctcctccttggcttacttctttggagttagtcttttttagtttagttcctggtcctcttctcatagtctaatttgaagatgccattcctgagcaatgtggtccacactcatggttgcaacttctttgccaataacctctaaatctttatcttctcttttctgagtccatgtcccacaaatccagttgcctcattgtacatctccactttgatgtaccacagttaactccaactcgaaatctctttcaccattctagaagaaataaacttctagaagaaatctcttccaccattctagaagaaacaaacatgcttttccacctaatctactatcatatgcttcatcatgcaaattaggcacctagacctttttcttgacactctccacccactgtcccctaaatatctaatcaacaagcaagtcttgaaatttctacttctttaatattagccgactatgtctgcttctctttatctccctgctgatatctcaactggattcctaaaatagccttctaactgatgtccttgaccccaaataatgcgccccaattctcacacaagccatgaatcagtactcttttcaaatatcacttcttccaggaagcatctctggatccctctcaaccagtcctctcttcacatagatcttgctctgggaataatggaattaaatagcatctcatagccaaagaacttcagaaatgctgatgttatgtcctgtttctgtaagaagaaattggaacaagggagatttatgctccccaaaaatattcttgaggtgtattctgctgtggagaatcctgaggtacatgtaaacctaagagagcaggagttcaggaattgggagtgggctccaagagagcagccagctctgtagaatccacactaatctgcctccaaacactccaagttttctaattttaccctttttctttggctttctcaccaaagatgtgacccactgctgcagggatttgggaaataaaatgcatcattaatcaaaaattactcttccctaaaataaaatattagctctgttgggtagttaattgcattatcagaatgagcagctcatcctcttttacaagggctttaaacactgatcgcctaataagtgcaggaattatagttaatctagctcaaaatttaattatgatgagtcatacatcacaaagcaagcacacggggcaaaactctggtgaagtcatgtccaactgaccttgaccccaggcctgctggttcttctttctaagtgggaaattggaaatccttcctgtttgtgaaataacagggacatccaaacaagacccaccccagtctacctcagaagtcttacgggaaagcctgccttaatcaaatcttgcaatgagaaagcccagaagcaattctccctctgggctctgcctttccagaccctgttagagtattatgaagttagatttgaagaacaccattacagtggatccaggctgggactaggtattaaggaattgcgtgagacgttcagaatttcaagaatgcatctaaatatatagtttcaaagactttcgtggttgacacagacctaaaaagtcaacagttcctccacgtggtatggctttgtgtcctcgaattctcccaattgctcacataactgaggacaatcttccaggtttttttctgagtaaaaaaagctgatcagccttcttcatttggaattttccacttctaataatgtggtttaagaagttattatctctgagcagttactggcacctaaattattttctcactggtcattttaattatttgtatacatatgcaggttgaactcaattgcctcacttttcattaatgactgctaaattcttttatatttaacccattattcaagctagtcatgactttggggaatactctttctgccctccaaaatagctagatcttcttcttgctctttgccatctgtactattgaaaagcaattctattttttgtttcctgtttggaaatcatacatagtttttctttaccatttcaagggtgtatcaatctctatgtatttatttcctgatgagggtattaaggaagtctcttatatgtctttattcaatcttcctaccctctaggttgacttccttttcttggtattttggggcttaggagaaaaagattttgatctaaaccttccatgattataggcatgttagtcatatttccttctcttccattttgcttatctgttgttgtgctacaaaccatccaaaatttagtggtcttaagcaacaattttatgttattcattatttcatggatcaggaatttgagacggccttgcctagtggtttgtttctcattcatgtggagttggctggagggctgggactggacactccactttcaagatcgcttctgcacctacatgtcctcaaggtctggaaccttgtaccccacctcaatatgacatctcatcctccaggcccactcaatatgacttgagcttttcatagcgttgatggtcttagggtagtcacatgttggctggctttcaagaaatcagtgaaaatttccagagcagttaagagctattccaagtactgtaacagcatcacttctattgtattttattggtaaaagcagtcacaggtcccatccagtctcaaaaagttagagaaatagactctacttcttgatggggtagtggcattgcaaaacagcatatagaatatgacatattgttgtagctgtctttggaaaatacaaacttccacactttctatagatttccagacttaaaagtctcatactttaaaatacacatggaaagactgtacaagaatggagaaatttcaagaaataaagatttaaggaattggactatttaccttgaagataatatcacgtggtggatgaaacaaggatttaaattcataaaaatctagattcaaatcctaccatgaatcttacaaattttaaacccatggaaaaataactttatacatcaataaacatttactaagcattttaatatgctaagcattgtgctagaaacctaggtatacataaatgcctaaaacaatatataagccttcaaaaaggatcttgaatgagacccatgtttcatgtttgggtaaccagttgttttgtgttgctatttactgtgataaaacatacaggaggagataatagtttctatataagctaaagtgcagggttaagcaggggaagatgtcaaataggcagtcagaaatactagaatactgaatggtctggtctaaagatacagttttggcagtgatcaaaataaaaatggtaactgaagccctagaagtgtatgagtgtgcagagcgagaagaaaaggtggcataaaaatgatccctgataaaacatcagtgtttatggggtaaatggtgaaaaaggaacttgcagagaaaagattactggatttgaagacataacgttagaagcctgaaaattaaacaaagagaggaaaaataaaaaatgtcaacatagtgttaatgagctgtgagaccactgaaatcagcctcatagacataatcagagtcatcaaaggaggagggaggacagaaaaaatattttaagaaataatggctgaatatttttcaaattagataaaaattatgaacccacaaatctaagaatctcaacaaatcccaagcataaaaattgtgaaaaactacaccaagggacatcataacccaattgcttaaaatcagtgataaagataaaatcttatctttaagataaatcttaaaagaagccagtacaaggggactgggagtggggtgggttaggtgggtggtggaagacacattacctaaagagggacaattataagaaagacagcagatttcttattggaaatgatgcaagttataagacatcagaaaaaaaatatatttaaaagcactgaaacaaacctgttaaccatgctaacaatggacacaggaaagctaaagtggctatatcaatacatgcaaagtagacttcagaccagtgggggtcttttcataatgttaaacaggttaattcattaaaaatacataataatcttatataatgaggttcaaaaatacatgatgcaaacactgatagagcttagacaaatccacgatcatggttggagatttcactacccttctgtcttagtctattttgtgttgctataaaggaatatctaaggctggggaatttttaaaggaattagttttatttggctcatagttgtgcaggctatacaagaagcatggagcaagcatttgctcctgatgagggcttcagggagcttccactcatggcagaaggcgaacgggagccagcaagtacaaagatcacatagcaagagagaaaccaaggtgtggggaggttccaggctctttttaaaaaccagcttttgtgggaactaagagggcaagaactcactttccctcatctcagggaggacatgaatctattcatgaggtatcagcccccatgacccaaacacatcccattaggctccacttccaacatcggggattaaatttcaacaggaggcttggaggtatatccaaactatagtagcaacaaatgatagaaaagtagaaggttagtgagattggaaaagactaaaaaagcgctttcaacgaaattgaccgaagtgacatttatagagcacttcacccaaagtattggaataaatatttttccgagtacagatagaacatttatcatgatagaccatattatggctcataaaacaaacctgaatactttaaaaaaatagtaaaattatacaaatatattctgatcaatatggaattgaattagaaaccagtaacagaaagacatctgaaaagttcccaaatattttaaaaaaaaacctaaacaatacacttaaattacccgtgggtcaaataggaactcataagaaatggaaaatattttgaagtgaataaaaatgataatgcaaaataccaattttgcagattgcagatgaagtagtgctcagaggacaatttatactatgaaaggctatattagaaaagaagaaagggctcatatcaataatctaaacttccactttaagaaactataaagtaaaagcaaattaagctcaaagtaaggagaaagaggggcataaagttaagggtagaaatcaataaaatattatgtaaaacagaaatacaattgtgaaaatcaacaaaaccaaaagctaattttttgagtagataaataaaattgttaaacctctagccagactgttcaggaaaaaaaagaaagaagacataatttactaatatcaggaatgagagaggtgataccactgcagattttacagataatgaaagaatattatagacaattttaggctaatagtttcaacaacttagatgaaatgagcaaatttcttaaaagatgtaagctatcaaagctcgctcaagaagaaagaatttgtagttgaaaacctttctacataaaaaattctaggaccagacggcttttctggtcatttttaccaaatattgaagaaagaaataataccaatcctacacaaacatttccagaaatgtaaagatgagggaatactttacgactcagtctatgagccagcattaccctgagactaaaaccagttgtaatcaatacaagtaaagcaaactatatatcaatatctcttacaagcatgaagatgaaaatgtttaactaattttatgaaatcaaacccagtaatacatttaaaagatactacatcatagttaagtgaaatttattcaaggattgcaaagttggattaatatttgaaaatgtcaatatataataattcaccatattaacaaagaaaatccatataattatcttagtaatgtagcaaaaacacgttctacaatattcaatgtccattcctggtgttaaaaatagaaacttctatgcaaacctgccatagaagacagcatcttcaaactgataaatggaaaacctgctgctaatatcacactgaatgttgaaagactgaatgcttttgccctaagattcagtagtaaggtaagggtgtctactttcaccacttctgttcaatattttactggagaccacactcaatacaataaggtgagaaaacacataaaagacatatgtatttggaacaaagatattttattcccagactacaggatcatctctgtagaaaatcgtaaggaatctacaaaaaagctattaaaagtaataagtgagtttagcaaggttgcaggatacaaggtcaatatacaaaaatcaatttttgtaccctagcaacaaacaaaaggaaattgaaaaattttaaatattattttcaataccgtcaaataatataaaatacttaggaataaattcgacaaataacatggaaaacatgtacataatattgctgaaagaaattttaaaagacctaaacaaatggaaagttatgtttatggatcagaaagctcaataatgataagatagcagttttctccaaattgatctacagattcatcataatcccattcaaaatcccagtaggcttctgtatagatattgacaagttgattctaaaatttacataggaattcaaaggacctagatgtgtcaaaaataactttaataaaaaacgaataactgcctggttttaagatttatagtaaaggtataataatcaagatagtatagtattggtataaaaacagacttatatatcaatagaacagaatagagagtccaaaatagacccacacatataaggtcatttgatttttcacaaagatggcaaggcaatttaatggggaaatctttttcaacaaacttctgaaacaatggaaagatcacgtataaaaaagtagggcctcagcccttatctcatgttatatataaaaattaactcaaaatggatcaaagacttaaaagtaagagctaaaactataaaacttccagcacaacacttaatagaaactctaagtgactttacatttggcaaagattttctaaatagaatacaataagcatgaggacttaagcaaaatcaataattggacttcatcaaaattaaaaactattgtttcctaaaaaatactattagtaaaataaaaaggcaagtcacagatgggagaaaacatttacaaatcacatatccaataaaggacttgtatctagaatatataaagaatttttataactcaataataagaagataagcaatacactaaaaataggcaatagattagaatagacacttcacgaaagaagaaatacaaatggcaaatatgtacatgaaaagatgttcaacatcatttgtccttaaagaaatgtgaatcaaaaccacaatgagatatcattacacatccattagaatgtctaaaatgaaaagactgaccataccaatgttggtgaggatgtggaacaactggaattttcattcatttctcatgggaatataaaatggtatatccactttggaaaacaatgtggcagtttcttaaaaagttaaacatatacctatattacaacccattcatccttctcctagctatttaccgaagagaaatgaaagcatatacactagcccacaaatgctcattgcagctttattaaaaacagccacaaactgtaaacaacccaaatgttcatcaacaggagaatggataaataaattgtggcatatttatacaatgggatgctacttagcaatttaaaagagcaaactgttgatgcatgcacaacatggatgagtctcaaaataattattttgagtgaaataagccagacaaaaaaagagtacatcctgtctgaatccatttatataaaattctaggaaatgcaaactaatctgtgttgataaaagcagatcaatggctgcttagggacagtgtgtgggctgtttggtttaccaaagggtatctcgaaacttttgttggtgacagatatgttcattatcttgattgaggtgatagtttcatgggtgtatacgtgtgtcaaaactcatcaaaatgtatattttaaatatgtgcaatttattatatgcttcaatacaactgtaataaaaagtaagagcaggactaaagagtaatcatggtaaatgtagcacagtggagtagtatgattgatcacactgagttgaaaaaagaataggaagtgagaaaactgagattgggtatagaccactgattttttagacttaaaagatgagagcagctttaatagtagatgaaggggacagtggtggcaagaaaagatttctaaagaagagggacagttgagcatatgaataacctgaggttagggaactggtagggagagagggaataaagagtcaggaaagagaatggatagtagtataagcaagattctaggggagataggaggaggaaaattagaggagggtgtacagagcaaaggtggagaaactagaggatgagggccagttcttctgaaactaaaagagaaatgtgaagtgagagctagtgaagccaaagagacctttgtaggtatggggacaagaagctgaagttaacttcaatctcctttatgaattaggagtcttagccattgtatggggtgcggtgagggtagagtgaaagggactgttctttgagaggagtgatgaaaaacttggagtatagatgggagaaaaactggagaaagaggtgacttggggcatgtgaaaggattgcagggtggccagaaggaccaactgaggttggaaattctgactgttagaggtaccaatacttggggtgctgctcctttctcccacagtggccattatgacatcagagaaatcattagtttggagagactcaaaactgaggctaaatagtgcagatgtggtcattggagggcaaggggaagaagaggcagtcaatactaaataaatatgctccaagatcctggctggacaaggaaaaaagtgaagagaaaaggaaggtcttgggctctggcccctcagtgaagccaaagagcaaatggcatggacccagccttcatcaggggatttgggcctcagtgggatattggagttgaagccacacccagtgatgtcaagtgaatgggagtggttgaggtgctcagaagttaaaggtcagagagacgtgaggccagggtgtttggggtgggactttcgtgtgtatattgttgaggacacccaggatgaggacagaacttggagtgtcaaggaagcctgtgagctggtccttagagttcaggaaatgatcatcacaagggtggtagatgctggtatagtatgatgctctatgtcttaatggagtttcatgccttgaaatctagtggaaaaaacaattctactactgaaaagattcattttaatttgattaaattctagggacaaagtttcaatatagtcaattttgtttttttcttatgccagtttttttgaagaggtggtttgaacacttagttcattgcatctctgagagaacaaattaagataatgaatttaaaatgctcaacccagagcgtggcacctagtaagtgatcagtaaatgtaagcagcaactattaatattactgtgcttttgatttgttttaccattaagtaatgttatctctttgaagacttatttctatggcctatggattttctctggagctttaaggcacagttctgtctctgcaaatgacaaatcctctgacttctaaagacagccaagacatctctcaaccctaggcaaaatatccccaatttctcccctgttcctctaaggatctcctttccagaatcccagtgaaaaaaaaaaaaaaccacaaaacaagttcagtcataacttgtctgtttccacaggttcacagctagagagaaatttagcctcaggacaaattgtaccttgagtctcactcatacatgatttagacgatatttagatgataccttgcacttaagactttagagttgttgctggactgagttaagacttttgggtctgttgagatggactgcatatattttgcatgtgagaaagacatgaattttggggggctaggggcaaaatgttatggaatgaaagtttgtgtccccccggaactcatatgttgaagccataactcccaatgtgttggtagttagaacggggccttggaagtgttagatgaggtaatgattacagagccctcatgatgggatttgtacccttataagaagcaatatcagagaactagctctctctctctctctctctctctctctgcgccatgtggggacacagtgagaaagcaatcatctgcaagccgggaagagagccctcatcagaactcaac

SEQ ID NO: 3703 - DNA, 31526 bp, human
tgcgagctgccgggcactcagcgcgggtcatggcgtggatactggactgccttttcgcctcggcctttgagccccgcccccgccgtggtgagtggggcccaccgagtcggggggctggggtgctcggccgggggcggccggcggctgcagccccctctgggcgccctggggcttggctggtcgcccccttgcctcccttcctgctggcttttagctaattgttcctggctcaagggactgccccgtcgaggccccgcataaatcaccagctttgccgggaaccgcgagcaatcgcgctaatggctcggcggtacgcgggacgagcgcgtgggcggagtcgctggctcagccgccggcagggacagccagagccttggggccagacgcgcaggagcggcgtcccgcaactcaaggaccctcaaggcccaaggatgaatgtccctgacagggcaagccaggccccagggaccctgaaggaggcgggtattcattttgccttgaagttcgtccccttgtctcaatctcaaacacagaatatcagcaatggaccccctagagtcgtcgaatttaaccccttcatttaagagatgatgacactgaagatgggaaaagcctgcccaaggttacccaacaggttggcagcatacctgggtcagcttaggctctgccagctgcccactgccccagactgcccagtagtggacccctgcggtctttagtcgggttctttccttgggtacttgagatcaatgcttggtttccctatttctgtggaattgaggacacaagtgtgcaaagatcacagcaccggcatatgtgggtcacatttcaccccttttcgggaactgcttctacaaagtacattttgacaactgattatattttcatccttaaagtttcaggagactgatattttctttttgacataccccaggacccccacccacactgtccttcactcccccttgataataagccccacccccttcaggctgccacctgcccccacagccacctgttttttcatagtctccacctccaaaatctatattggtgagagtgcgtcattgggcaccagccatagaccaaacctggggttgtctcctctttcctctgtcccttcacaggcgggggaggggaagcagggaaaggaggggcctcagcaacttaattcagcagagacctgtttttagttcttgccagccccaacaccctgctgagaaccatcccaggagtttgacctcctgctgaaagactacagcttgcttaggcagttcaagtacagcctcaggccagcaacaagatctctgagaaggaaaaagatctgcatacacacagagtttaattttttcttttgcatatttttaaggtttatatgatcctggtgaatcaaaaatataagggagttttataagatgtcttttaaggccttactgctctaacagtataccctgaaaaagggggtgggggaaacatttcacagttgcttggactagaaggttgtcatgtgactccaatgagatcaaggacatgaaggctcctttatgagtaaccacataggagggagtccatattacaccaggaagcccattcccatctaaaaacagcaatgtctattagaattagaaggcttttctttaaactgaacccaaatctatgtcctgggaacttccaccttctggccctggcattgacttccatggtcctccttcctaggaaacagtgtcagctctccccattgtcccatcccctactcaccctgttcttacctaggccaaacttccccagtttcttcatctatttaacatgtgacatagcttcaaggcccctacccatgtctagctgcttttctttgaacatgctccaagttataaatgtccagtgaccaggccaaaagaggctttccagctgtgcccctataaatatagtcctggaaagctgactttccctcttttagaagcctacaccacacccaaggtacacacatacgtagtcataaacacacccataacatacacattaccacacctatgcatgcccatttgcaaagccacgaacacacacacacacgcttcacatgcaccacatactttccacacacaacacaatatactcacatcacctgtgtatgcaccactcacaaatcccatgcacagccacacagttcacacaaagactttattcacattgaattactttcaacgaaagctactctttttccttaagtaaacccaagttctttttggagtctccattctgtatttggtgtttgaactcaagtgtaagaccttatattcgctgctgcatttctagtctggtggtacctgttccccaacatacccctgcagcacaccactgcctacatcagctctattactcaaacaacagcagctgatatatgtgaagctcttcccaaatgttgggcccttaggctcaattgcttacatgtataatctcacttaagtcacagggcatcactttgaaataaataatctttgggtagttttttgactgggcaacagctcatttcattgcactccccctgagaaatgctgtacaatgtgaagggtaactttgtgggtaactattgatattctgcagggctataattgctttggtgcctccctttgaatgtccttcagaagtcttcaggagtcagagatggggttgggggaggaagctgtcagctgactggacagaactggggcagtatctaaatgttccttcacccccattccccttgcccaagagatagctggcatgtgacagcaattttttttttgaggggcaggtttattttgtcttcattagaatatcatcactcttttgttgatgtttgctatttttttttttgttcaactcttttttaaaaaaatttactttaagttctgggatacatgtgcagaacgtgcaggtttgttacataggtatacatgtgccacgttggtttgcatcagagagatttttcagggcgacaacgggcaatgggcaaccataggaaggcacttgggagaggcatcactgaggtctgggaggaatgagggcccagaaaggccttctttcccagggaaagagacagcacaattgacccacttgaaattctctccccagttcactcttggcattggatttggcctcaaacaattggacttctgtaaagcagccaaagctctaaagctgaagggaccctggggcgcactttacatacaaatttgatcttttcttggagatgggaccgaatcgatttgctgaggccaggcctagttgtgctgcagcaggatcagtttccaaagctggggcgtgactgccaatgagaccaatgagacaccccattctccaagtcaggtcgtcagataagcacccccattcaccaatggcaggacttccccaattttctttattacttgtttgtacctcaaaatacatttctcccaaagaaaaaaaatgtgatgctctagagcttagcccataccttacccatcgtgaggataaaatacagaatctgtgtgatgaaaactggcagaaaataatactcttgcaaatatatctcaggctccagcagtagagctgacatttatcaggcttaaatatcaaatgatggaaagcattgagcactgatacagcaaggcaccaggtccgtgagggtgattatggcaatggtgaaagtaacatcattccttttttttcacacctacctactacaacaacctaaatgtccaacaatagtggaatggttaaataaattctgtgatatatccccttattagattgcacagaatcataaaaattgtttttgtgaagaatatgtaacaacatagaaaatggtatgattgtaactgtcaaatatgcatttttgaaagactagaaagaaatcgacaataagataaagttagagaatctattaaggtggtgggataatagttatttttctctatgttttctaaagtctatgaagtttgttcttcaattactgttataatttaaaaaggcatacaagggtaaatttagtacctgtgatatgcaaataatctatacagtgatctagaatttcactatacatagtttaaagaattttttctcctaattttagtttaaatgtaatgactagatccggccagccaaccatgatcttcccaatgatcatgaaatttccactaactctgggtgggaagaggaacaactggtttgaatcccaggccagctcttataaggttgctgtgagagagttacttaacctctcttaaaatgacataataatgtctatattttggggttgtaaataataataatagttcttattactgctgttgtagatgtcattatgttaaatgctttctatggctcagttatcaaaagaagcttttttcccaaatgtttactatttgtaaataccagtcatactacataaactatctctaaccataacaactttctgaggttagtattattgtctctattttaaggacaaaatctcagagaagtttagtaacttgcccactgtcacacagtggctgagcagggattacaatcctttttgatctgacttcgaagcttgagtgaaattaaaagagagaaacatttgcaaaactcctatgctgacatatggcagacatttactaggtggtcaacatgatgttggtgatactttgcccaggacccagatgctggtctttgacttatttgattatctataaatttctttctgtgaaaaggaatttcaactgaaagatgcaatacaaacgcaccacctgtgtcctcatagatgtggctctgagtcactaagaaacgatttctgtttccttcggcagtatcatttgttctcacatgtatcagcagaagtaggtagatggcatgtttgatgagccttggcagctactgtcacgtctcagatacacttcctgagaaaccacgcggcttcctcgggatgagtactcaatactcagcagctggtaggtccctgcttattaaggaaacttactaagtggcatgggcatatctggaacccctgctctaactattctctgtctgatgtggttgacacctaattgctacccctcccatttcccttttcaaagctaaggctccaggatttccacagaagcatacaggggtaggagctggagaagtttttcgaaattcttaaatcctcagagggactcacttgcaaggaggaatctagggttagtgaaggtagcatgcaggataaatagaagggatgaaggagagggaggagttgaaggcaccttccagagtctgggaacatctaggggtggacctctcagagcttttcctgccatgaatctcaatacctctctactctgtagtctctttatccctccctgggattatatccaccaccaccacccctcccccgcccccaatttcttgatcttccaccaccgctccctgcttaaatgcagctttagcttgcagtgacttgcttttgtctctagagggaggcaaaagcaccagggaggagggggttcagattggggtcttcttccacttcactagttttggcaaagagtagaatttattttcctttcattgggaacatatgaataaaagctaatcagagatgtattttaagtgctgcatagcatatctcagagaaccatcatatctttctctatcattccatctacccctcaacgtaggtggctgctagaaactggatggtcttaggcactattatttctagagtgaaagtgagggcaaagcaaaacaggagtcatagggcaatcttagccaggaaatagtcatgcttttattttctggggcacaatggcacatatttaggagactgggttggggctgggtcagcaattggggtggagggaagtctggacagtgagcagaaagtttgaaactttcctgtgtggagtattacatctgaaaccttggtctcattaacactgcgaggagaaactgcagagtgagaattggacttaaggtccagttcttccggggctgcattaggctgatcaaacatcttcctaaaagaagagggactatttcaagagtgtcagacaagccagtaatgaggaaaattggcagtttagtcagttggctccactccctgaacaccatggttgagacactctgggctacatgagaacgaaaaaaagtgcagaagggaattaactaaccttttcttaaacatttactgtatctgttaaccacttggctggtggtttctatggtttacctcctttagtcatctgagcaattctaggcaggtgttaacatctccattttacagttgaggaaactgaggctcagagaggtgaagtatccttcccaagatcacacagcaagtaagtgctcgagctgggataccaacacaaagctgtctcattccgaagcctgtggtctttctctgccctccccacatggaaaaaacaaaagccctgattttcaagggctttactctcatggggaaaccatgatctctctccccacaaaaatccacattttggtgccctgctcctccagattcttatatttagggtgaaatcaaacaaatctctgtttatattggacagtaatgggagttagtaaagcattttcacctttacaattccccatataatcttcatgttatgggaacacattttctgaactccaaagagagagagagacttatgacagcgattttaagctccaaggaagtgtgtgtgtgtttgtgtgtgtgtgtgtgtgtgtgtgtgtctgcgtgtctgtgtgtccatcccatggtggtggcatattgatagggattctgatagcccctcttattgccccaattatatgggtggggggcattagagaaggatagctttcaattattctaatagcccctggcccaggactgcatctttggagacatagcctggagcttttggcttcttcagagttgaagtttgtcttccattgcacaggcaggaacactgagctggagtgaaccagatggtctttatgaaccaaagtggaacttacacaacaggatttagatgggtagtctagcgatgtgtttatgcatttgtgcgtatgtgtgtgtgctggtgttgagaagcaggggcagaacctctgaggaagagaggcctcacatgaacagctgtgaggaggtggaagtgaagccagtatattcagaggagaatgaggaggtgtcagattggccccacagcagcaggaaagctgagcatctgagaccagatgctgggagataccaaagtttgcctgaacaccttgtatggatttaagtttaatgaaaccaaggggcttcaggtggtctatgccctgcctgagtaagactgacgtatttaggctccctttccccctccaaaggatactttctggctacataatactttaggcaatgctttctgtgcccacccaggatgaggtgctgacccaggcccagctggggggaagctttatggatgttccaactgcttttcatccacgcaccaggctcatttgtgccagatgaaagggcacaataataacagtggcaatttaaatcgtgcttctcactttccccctgaaaagtggcgaagtgactcaccactgttgaattgtccctctctatccaccccctgacctctttgcagcagtctaggctggttccctgggggctaagctgggagctagagcttccagaggccctttagctgtgactgggatgacatcatgcccccccataaatgtgttccccaaaatgcgatgtattgctttaatttgggtttctcagatgaggctgcttggaaggcattagagcagcatgagccccattaggcaagtgcagtgccccccgactcatgaataatataaaatggggtccattcagtaatcttttctgagggagaggctctgcttgtttttctacatgcagtttggtatgcagatgcttgctctatttgaaattcgccatataccaacttctggtagtgatattgtaaaaatgggtctgggggagctgtgaaatcattctgttactccaccctgattcttcacctccatttccctccatacccaaatcccctgaccctgtggctagaaaatgttcattttcaactctttctttcagcaccagcctacggagagctcccagaactggagctagtgaggtgcacttgtgcctagagtaattacagattttgaagtatcaacaaagcaggtaattaggtggagaaagtatccgctgtctgggagacaaagacagtaattatgatgagtactcttggtgctgtcagtaaactcaaaagaaagatttgtagagaaatgataatgtttgatagaaacttcaatgtctagcaggaatcaggggactcttagtaaagccacctggtatgtaatacaggtttaggaaatatggtagacctgagttcaaataccagctcagcctcctagggtctgtgtgatcttggggaaattacttaactactctgagcctgatgtatgaagtgtaaaaatagcaataattatagctctgtctaccttacaggatcattgtaaggacccaaggagataatgcatgtcagaacacttagcacaatgcccagtacacagtaggtacttaacaaatggcaacattattattattattacaactatccttgctacataccaggtattctctacagccgttcagagtttaaaaagggaaagaaatgattgcagttatgtatgatcatggcatgagaagtatgaagggtgtaattgtggtggctcaaagaagcgagccctcagttgagagggaaaagtacagaagagcagagaaagttttgtgattctggagttaggtttaaaaaaaataagtaggagtttgtcacaaggcccaaggggaaagggcttccaggcaactggatctgcccacacaaagccaaaaaggtgtgaaacagccaggccctgagcaaatagttgggctcagctaggcaccagctgggatctcctgggcgggggaggggtgtcaggtcagagaccaagaatctttccagcttactcccaccagcccctgtatcgcgccctaggcgccctacctggccaatcacgtgcggtgccctcctcttctttcctttaagcagccaggtacattcacaccctgccccagcgggccttgccgacacagaggtgggcgggcaggcgaacccccacggtgaagatcagaccagcgggaacccctgccggggtcgcggcccctacttcctttcttctctcagtcccagcccaacgtcccactcgtccccgcccccaaccacacacacggtcacttgggttcttttagacaaccctgtactctcacacaccgcacccatacacttacgcggcaatcccccttcaagacacacacaaccccttcatccaagcacgtaagctgaccacatgcgtccacaccacacacatgagaacatcacaccaaaagacacacaccgcaccctcacatgcataaacctttgaacacacatctcaagtagattgacttatagagaaatcttgcacacgcacacattcacacactacacagttcaacagacaccacctgtaaacccacattgacacactgcatctaagcataaacacactccacacatatgcacacaagcttcaacgggcacacacacatccacacattgcacacacatatacactcaccacagcacgaccacaaaccccggcaggaacagcacacacccaccttcaaaccgcacccacataatcccactataatcgggcagaaacatacaacctataagcgtgcacacacaaacacatgctgcatgtcaaagcgcaaaccaaatacacaccacaccaagcactccagctaaaacgtgctccgcgcacacaccccccacacccggccacacaccgaacgcacacacagatctaccgcacccgcgcgcgcgcacacacgcttacatgcatacatacatacatacacagcccgcccccgccttccctttgggcggaagagaagggggcgaggaggagaggaggggaaaaaaggaggggggatgagcgagccaggcggggcgggcacagatgctcttttccttttgacctggggtgttgcccccatgttccccattcccaagcaaagggagtaagtgagttggatccaaggaaaatccaggcggaacccaggaaaacaagaaggtctagggaatcagcgagctggcgcgaggtctccgcggggaccctgactcagcgcactgtcgaccccgccggaggctcctcctcccagtaccctccccctggccctttcactgccttgacctctgtccccctccgcacccccaccctcagccaggacatgtgcttctctccccggcccccacccgcccccaccccccgagccccactggagagaactggccactgttaagggttgagggctttattggtttcaagaagtaaggagttaagactggcagacaagctttttgcgaagcctgttctaatctagcttgaagacttttcttaatggagagctcactctttctcaaagcatcacattttctacgtaaagggcaatggctattagaaatccccgaccccgcgctggacacatagtagggctctctaaatgttcccccctcccgcttatgtcaccacatttggcaaggctgtctgcagcctagcactggctcgcaacagctgttgggcagtcagtcggtgagctcttttcttagcccactagccctcctgaaaacagcagcttcggactgggcgccacaggcggcagggggcgatagagtcgctaacggtgctttgcacttctggttctggccgcacagcccctgtgagaatctctgaggtgccctcccgccataagcggactatgcgagtggtggcggcgggggtcactccggaatgatccgcggccagatgactttctggctcctgtcctccacttgcttcttttctgtggagatggacagcaagggaaagggagatggacctccccctccgactaccccgtggcgcattatgtaaagtgtcatgtaaaaatacccaggcttcagagttctttataggttcgaatcccagctctgccacttcttagctgactaacgtggtaagtcgctggcttaggtcgcggggtagttgtgaggcttagaggaagtaacatatgtgaagtacttcttccagttaacatacagaggatgtccattccctccctctttcccccaccctcttcaaaaatataaagatatgggagtttaaaagaaaggggattagagtctggcaggggggacatggccaccagctgatgctcccaagccaggccagaaacacagaggacgggcaggagttcagttaacttgcaatatgctgtatttaagggaaatgcctgcaccaatgatttggtgatgccattcactggccacaagagaatccaggtcacaactccaatccttggatttgtgatgaggctgttctgcccatcacctcccctccttacaaggacttcctaactcacctccacttgtattcttttccttcttacagagatgccacagtaatatttttaaacttcttgtgagcactccttgggtgccaggaatgtctcctgttaacttatgtcccagcagcatctagcgctgtgccagacacacagtgcaagcgctatacaggcggcaagagatgtcctgggtgaaatccctaggaaacattgagactcgagggtacatgaggagttatcataaggaacctaaagagaggaccctaggcactgcagggatggagggcagtggctttggataaagagttattccattggacaaagagttattccattggacaaagagttattccattcctcctcaaagccctccacctctaagcctgtctggaagagcattgcttcactgcggctgaggcttctgcaggcaactaagaagaaagcctctttcctggagggcagaggccctggccagctagagggtgattcaccatctcagttaggtagcagagatggcgctaaagtggcaatgaatcagtccaagatggcatgaggagattacctgagtgatgatgagaagggggatgaggcaggagcctgagcccttgaggctgggactgagtgatagaacgtctatattcatatgcacaaagtcagctcctaacctgcctccccagttccacaaccaagtccccaaggatagcattggcacactcctggggaggggaatgtttgggagacttgggttccaatcctgactctgctacttactatgtgactttgggcaagttattttcccctctctgggcttcagtggcaaggtaagtgctaggtacttcacctatgtcatttcacacattcctctccacggtattattggagcactaattttcctattttgcagttgagaaaactgaggctgagtgatattttgttatctaccttctctctatatcatgcggtctttgtgtatgtatgttaccaggcaatcgctgtaatccaggcctcttctagtatgccagtcctctatttaaattggatccctatgtactcaggttcaaatcgtgtctcccagctgcccccaataccagcccatgttgctagttacctgggtgggttttcttttcctctccggcgacaccctctcccacctcaactcaagtttttttcctggcatataggtctaaaatctcacattaaaaagcaagcgtcaccagaaagacgtactccaatgttttgtgttttatcacagtggagggtgctggttgcagggtgctggttgcaggatgctgcagtgaggaaggggagcagagcttccagggccagagggaggggctgcagaaaaatccagggagagagagaagacagagagagagagagagagacagagacagagacagagagagacagagaaagaggggatgccagggacaaattggaccagcctcaaactgctgctccctccctttctccccctctacttacctggtgctctagaatgtataaaggggcagcacccagtccacttacagcaggaggagagggagaggtcctctcctctcctctccttcaatggaagggcaaattgtcctgagtattcaaattgtactcctgtgttgggtaagatttatttaattctggggggaggggagggcgagggcctcatcatggtagcaatgatggtgaggtggcacttaaattgaaaagagcaccaccagtgctgcttagagccagacgctctctctctttactagaggataagtgaaacttgacactgggcttctggatcttatttccaatccaggcacctaagagtcatatctctgagcctttggagaataagtccatgtctgcctgggcttccacagcagctatacttggagccagcagctgtactctatcctttcccttcctttttcttccttctctcctttgcccaggctctgcttccccatgtttccctcttgctgggctcacccatagtctcttatattcttgactcttctctttcttctccatttctgtccctctttgttgacaacactgtcccttgtgcatttacttggcccaagacaggagagaattcaattggggggggtgtaattgtgtatttgaaattctcccacttaagatcttgtgattataaccccatattgcccttgttgcatcagataagaatattaagctcttgtaaattatatatttttgcttggttgaatggtgatttgtatatatgattggtgggctgcagtttagaagagagtatttttggaagaggtattaaaaggtaagatggtttgggctggtgtagatggcctcctgacttctctaagtgcctagatatgcaaagaagacagtacatgaaaaattaagactatagtagtggggggcaggggtgggagaccattgccagccaggtcgatggaggactttgtgaagtcagcttctgttttgctcttgctgatcattgaactttgaaaaaaatgacctttttatctctgagtttggaagaccagaggccctagacaagaagaccagaggccctagacaggaaggggaaacaaaaagcagaaagagtgaggcaaggaggggaaaggactattccttgtgcagtccttgtgtgcaaagggccaacaaagaatgtcccctgccctcaaatgccacaccagtcaaggcagaagggaagcaaagtgctgtggcaaattgtgtgctgagctgggatccaggagttctggaccttcatcttggctctgccactaattagctgtgtccttgggtaagtttcttaaccatctgaacctccatttctgctcttccttcacttgtactgtgagattgtgtggcatggccaggggaggggaggttcagagcattcagagggaagggacccttgggctgaatcttgaaggagagctctgctttgaataggggagagaagattgtggggtacagtgagaaccagtgggagtggcccagagaattcagcaaacaggtatacgtaaggcactgagctggctgctgggtagaaaattgctatgaatcagccccctcctcaccgcggcaagctttccagagagtaggggaatctgagaggcagagccaagcgctggcagtgcctgcagctcctctcagcactacccgctgccgcccgccggactgtcgagcaggtcacgcagcctttccctggccggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatcccatctagaagtgtgcttcctgctgacagtgggtgagtacccattttcatcttcaaaggatgatacagaggcattcttcagcaggggacactatctgcctcattccagatagtagcacttctgctaagtcttcctctcaagtttggctcccaggtattttggagggcaattcctcaccttgcttgtttgcttgcttggcatagaaatgtaccctttggagaacactttcattctacccttttattttatcttcacagccacacttaataggtaccatgattcttgttttgtaaggtcatggatctgaggctcagaaaagcaagataatttgctctctgtcacatagttagtgagtgtgtaaacttacatggagtgaagctgggatttgaagctaagttccagtctatatcacaggaccttgccaggataccatgctgtcaggttgggggtgggctggggtaagaaatatggtgagatgcctacacagggcttttggtgtctttctcctctgtcaactcctctcctctacctttcataatagtcttttttttccaaaaacatatatatactcttcctgtaaatatatatatacacacacacatatataaacacacacacacgcatatatatgtgtgtatatatatgtgtgtgtgtgtgtgtgtgtgtgtgtgtccatgtatctatctttctttctatcttcatttcccacggaatggcacagagcaatgtataaaaataatacctcaaaaatccaaccacatccttaggaaagaaggtagtcttggtttagactttcccagttccaggcagcagatgttggtggtgaataccaagaactgctatggtttggtggaaagggcaaggcttgagttggggataggaagggagagctggttcccagatcatattcctccatggcatttttgtgcaactttagataagtcacagcctctccaaagtcttagtttgttgctattgtaaaatggggaggaaatatccaacctacctctttcccaggggttattgtaagaataaagtggcatgattcatttattcatgaatcacgaatagctgttttaattacaagactctcaagagcttataatcctgtgattcactcgacaaacacttattgaacatctattgtgtgctagggtctggagataatgggcatatggaaagcttttaagaaaatgaaaagcaggagacaaattaggcattaaaaacttttacctcctattgatagaacattttatttttaacttcttccaccacaatttaatagaagcagcaaccaaaaggggaaaaaatgatatgcatgacacagcttgtgatgccaacactattatgcaccctgatacatattgcagataatagtgagaatatctgtatcttcgtgtacttgatgtcacattgccttgtttacactatcctttgggatgtttatagcataaaaattgcctttcaccatcctgagcctgagttgtttctttagtcaataaaatttaaaaacaggattccatggaatgacgactgtacttattttacaaagatgctgtaatatgtggtggctgcctgccgtcagatatgacctaccctggcttatggaatcaggctttgattatgtgtattcttttgatttctttatttagcaatgcagaatcttgcagctagtgaaagcaagtatgggtgcgtcaatggcaagagccctgagactgaagagaactgggttcttgtccaagctctgttgtcaaattgctgtgtggtcttgggaaaacccctgtctctctgtgagcctcagttttctgacctgtataatggaggtttgggaccaggtgatggctaaggtcctatttctgaaacattctaatattataatgtttctgaaactttcttatttttttgaagccagggcttttctccatatattttaacagtaatattacctctagtttatgaccttctgctataacatgatgggctgactcaatgtattgatgaacactatccccagatttaattatcttggagcgtcatcaccacattgtataaaatgagccatattgttcattgcatcagcagcctttgctgaaatggaggttatgggataacaactttaaggctaactcattaatgctctgggatgaataagctaatgtgtcagcagaccaaactggtgcccaaatgttttcgtatagagacccatatctctttcccatgttgtgatacattaatggggatgtctttatccattgccgctgcctgtagtcatttgaataatgtagatgcagtaccttctgggcacccagccccattcactatcaatttcctaaactttgaggcactctcagaggcttggaccaaaattctagtgatgccatagagtacctaatttataaggatttaaaccatggcatcagtgcagtccctgcttttttttttccataggtgtttactagtaagcactgcaccattcttaactattttatgggggtaatggagtaaattagtcctccaaatcatgaaggctgtagatttatgcctagttgaaaccatttcagtcctcacaatgttgaagtgggtaacctttctgacgttaatttgtttctccatctgtgtgccatgcattttgggaggacgtgagaaacaggcttgatgccattcaagtgtgtttcccctttttgtattgatggaaacttgatttgtgcctgtccgctctttgttcaaattctctctcttgatatctgctcatattctagcccctttacttatccaaataaaatcatatatatatatatatatatatatatatatatatatatatattgctagtgacaatgtagaattggatggcttgaaagagaaacaaattttgagacatacaggcactttattaatctgaataataacatttgaaatattaacctatgcagttagtttttctaaattttataaaatgttttttttaaatacttgactctgctgaaattggagaatgaagaagaaagatatatcccttaaaatctcctaagatctctttacataattcaaatttagtggagaagagtagattgttcaatggattgatacaaattctaattttatgtaattacttttgaaacatgattttttttgtaaactccagccctctgcaaagaaccttcactattaacatgtttattaaaaaccaatgctaaataccacacataatattattcattcaactctcagacaaccactgaaatggatactgtgtcatttcaccattttatagagaaggccactgagactcagagaattcaactgactttcttaagatcacacagctaagaaatctagaggctggctttgaactcagttatatttggctctaacactagtaaaagtatttgtctaaagatagtgtttctgcaaatgttttgaattctagactgaaactgagctggtttgctttcatcttgcttttgaatctcatggtctcttcaggctagtgccatggtatactgaaggggtaaggggaaaacactttggagcaagagaggtctcttggcacctctttcctgtagggagcctccttttgtgttcagcttgaaatgtcaggcctgaagtattcaaatctcaagatcctgttatgtgcctctctcatagtgcgaaagcctgcctactcattccccctccccaccccacccatctgcttcttgtctggggacattggtcttcctaaatctgcttctgtattgtatgctactggcaccttgagaaggttgaaagcaagtaaggcaatgccaatttttctgttagaactgcagcatataactgctcttaagtttagccctgtgtgctggagcagggaggcaatgacaaacggtttattctaaggcctttgatttccttcggaattgtaagcatctaggctgactcatctctcaaaggcttttctctctctctccttttggggctgttgttgattggggattttactgtttgttcttaccttatatttgggggagagaagggactgattttcatcttatttttgggtgaaaaaaccagctctgctctttggatgatcagatctggtaagcttcgataagaagaaatagctgaaactccaaaacaggtacaaaagatatctggattggggaaaggggagaggggagtaatgttagagaaattaagccagagctaggctgtgtgtctcaggatgagaccctagactaataggctctggacctgctattttgaatggggaattgctagaggcttagtctggaactgtggttaaatgcatgtgcctttggttaaaatggtcactttgcaagttgcagtttggtggttggggttaggtgttcactttgggtccaggggatggagctttgcagttgaaggtttaatatctatgctaggtgttttcctcttggtttagttcaaaagccacaggaaaactcctcatcttttctcttactgcacctatttctgacatctgtgatcctggctactaagggaagtaggcaaaagagttttggagacaaaattcaagtatggtttatttgtttgtttgttttttgttttttgttttttgtttttttttttttggacagaaggtagctcatctatttagattattgcatgataaaccgttacttaacttttctctgccaaagctgcattgcctgatctttgaaatttaagctccccaccccccaaatcatatatagaatgttattgtagattccatgggaaagagacattcagtaaagttgtatgtaactacttcctttcttggcaaaaggtttagttccccatctcctgaattatcttctctatcaggaaccagccatatttacccaaaccatgaacttgggagctatcctaaattgttttctttccattgcaattaaagatgttccctaagccctgtcagttccatccatgagattcgtcccctactccagccctagtgacactgacttgtgtcaatatcccttgcctcttggctcatctacctacttccagctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtgcgtcaggtaaattggctatgtttacatgtttgttcctccaataagaaagagcaggaggaggtggggtttccccatagacctgactacctggtggggggaggagcagggtcttctttgtagcccccaggcccaccatattgccagctacctccactgaatactggaacctgttgaaggaatgaccaagatggagctgtggtgggccaggcagacagtccctgtcttctccttttcctagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaagtgagtcttctgacctccctagtagggcaaggaaaggaaatattactggggtctagggggttctagggacagagctcaggctggaggactttgaagaactaaggcaaaatgaccataagaagattttaaaaacctctccagaatatatacaattattatttgtcaattaaaaataaaattttaataaaaaacttatttgggttactttctttgtatttctaaatgttccattataagtctgttgcttggaaatttctctagagcttcttgaagatgtgtgtgccctctcaggtcaaaaaaaaaaaaaaccacccaggttctgtagaggaggtctggtttttatgggggcacttcttgctttcagagttcctgagctcaaatgctttggaaatgagcaaaggcaagatgcctgggtactttctccataactgccagcaagtttcaagcagaatctcacctcccttggtatcagtctgcagccaagactatccccctgagacagcccctgttttccttcttctagctttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtaaaaagatcttggaaagagtagtgaaaactgtagtaggggacatatgtgggagtatatcagcaagagggtggatggagaggagagagagaaacaagaataaaaagagacatattcatttgtacaactcccagtactacctcagcgtcaatcactttctgctttcctttgcctaggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtaggtgcaagttttggatgcacttgttttacacatccatctcctgttcacaaggcaaggcacagttgtacctgcatctttgagggtagccaaaacaggcagccacaagatcgtccagtctagaaattcctcccacattagctggccctggtacctttagtcctaggtacctgaaagagatgagtataaatgaaaaggtgctgtgtaatgatggctaatgttgctaattctaccctcaggtgcctccccatattcagaggcaggttgctaagcgcgtgtggaagtccagcccggaagcacttgattttatcagacgcaggaacttgaggaagatccagtgagtgttttttgggtttgtttatgcttagcctgaagtacctcctcctatggggttttccaactccagactatctttatattaagtaacgcaagtacacaaactgactttttcaaaatccttcccattcaggagtgcacgcataaagatggaagaggatgcactactttctgatccagtggaaacctctgctgaagcccgggctgctgtccttgctcaaagcaagccttctgatgaaggtcagttccctgctggaggtcaggcccttgctgaaggtcagtcccttgttgaaggtcaggccctttttgaaggccaggtcgttgctgaagatgagccccttgaggaagatgagtcctctgaggaagatgaagagctagtatttgaatatcttaatcaaggagtagtctttggggaagctcaaggtctagaaatcccaaataactttgagattcagggcccacatcttgaaggaataccagagcttgatgaggaagatgatgatgatgataatgatactttaaattttgatgatcttcctccccttggagatattctagaaccagataatgaaattccagaactcattgagatcccagactttgaagaaattccatattttgatatggtcccagaccttgaaggagccccagatgtgcaagaaatcctgaaccctggagaaaactcaaaccatgacctagaagaaggagcagattttgaagaccaccaaaatcttaaccttgcagaagctccctatcttgatgtaatcccaaacaatgaaatcccagaccacgcagatgcttcagataatgatgaaatccaagattctgaagaagatcccagtcttgaagatgtcccagctgttgatgaagttccaaatgatgaagcctcaaatactgaagaaatcccagactatgaagccccagaggtaaatgggatttcagactctgaggaagaccttgattttgaagaagtctcagctctttatgtggttccaagccctgaagaagcccctggtggacatgaaatcccaaatcatgaagaatctccagaggttagtggactctcagaccctgaagaagatcccagtcttgaagaggtctcagattttgatggaatcccaaaatgatgaggaagcctcagacactgaagaaattccagaccatgaagaagctccagagaccaatggaattgcaggccctgaagaggtcccagctctccatgtagtcacaggccctgaaaatgtctctgattttgatgaaatgcaagaccatgaagaatcctcagatgtgagtggagtcccaaacaccgaagaagcctcagatattgaagaaattccgggacgtgaagaagcctctgatgttagtggaaaccaagactctgaagaaagccctagtcttgaagaagattcagttctctatgtggctccaaaacctaaggatgcccagatttacaacaaagttcaagattatcagaaagaccaagccagtgcatttgaagaagaagaagttaccactatggctccagaaactgatgatgtctccattctcaatacaattccagaccctccacaagacctggctgtcaatcttgaagaagtcatggatgtggaagaagtcccaatgcctaaagatttaaactctaaagaggttcagaatccaaaggcaattcagtttcataaagatgcagatgttgcattccctgtagataccactctccttaaaaacaagtctcagcctggccaagtcatggactacaagtcctcaccagaggtgttgaagggcaacacctgctttctgtcttccatgcagtgctgtaagctttcagctctagctttgttactcatttgcttggtaaaattagtcaggttacttgtagggtggtggtggttattaggaggtcgccctcttacctgtctccctggtggtattgtccattccctctgagcgcagggtatctgtcttactctttctctttcctaactcagctcttttcccagttcccacagtggtcctagattcagagatctgtgttctgctgtcaggctgtagtattcttatatgtcaaatggggataatcatccctgtcctaccttcttgcctcatactgtatttgaaactcaaaattaggtcttagtgccttgggtgctgcgcaaagtataaagtctagaaacataaggagttaacattgttactatttttcaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagca

SEQ ID NO: 3704 - DNA, 31637 bp, human
tgctcgaggtgtccggtgaccgaaacactcttagctgggtgcagggtgcggctcagggcgtggtcaccgggggctacttagggccgccggtgcgggggacgacgcaaaggttaactgcgagctgccgggcactcagcgcgggtcatggcgtggatactggactgccttttcgcctcggcctttgagccccgcccccgccgtggtgagtggggcccaccgagtcggggggctggggtgctcggccgggggcggccggcggctgcagccccctctgggcgccctggggcttggctggtcgcccccttgcctcccttcctgctggcttttagctaattgttcctggctcaagggactgccccgtcgaggccccgcataaatcaccagctttgccgggaaccgcgagcaatcgcgctaatggctcggcggtacgcgggacgagcgcgtgggcggagtcgctggctcagccgccggcagggacagccagagccttggggccagacgcgcaggagcggcgtcccgcaactcaaggaccctcaaggcccaaggatgaatgtccctgacagggcaagccaggccccagggaccctgaaggaggcgggtattcattttgccttgaagttcgtccccttgtctcaatctcaaacacagaatatcagcaatggaccccctagagtcgtcgaatttaaccccttcatttaagagatgatgacactgaagatgggaaaagcctgcccaaggttacccaacaggttggcagcatacctgggtcagcttaggctctgccagctgcccactgccccagactgcccagtagtggacccctgcggtctttagtcgggttctttccttgggtacttgagatcaatgcttggtttccctatttctgtggaattgaggacacaagtgtgcaaagatcacagcaccggcatatgtgggtcacatttcaccccttttcgggaactgcttctacaaagtacattttgacaactgattatattttcatccttaaagtttcaggagactgatattttctttttgacataccccaggacccccacccacactgtccttcactcccccttgataataagccccacccccttcaggctgccacctgcccccacagccacctgttttttcatagtctccacctccaaaatctatattggtgagagtgcgtcattgggcaccagccatagaccaaacctggggttgtctcctctttcctctgtcccttcacaggcgggggaggggaagcagggaaaggaggggcctcagcaacttaattcagcagagacctgtttttagttcttgccagccccaacaccctgctgagaaccatcccaggagtttgacctcctgctgaaagactacagcttgcttaggcagttcaagtacagcctcaggccagcaacaagatctctgagaaggaaaaagatctgcatacacacagagtttaattttttcttttgcatatttttaaggtttatatgatcctggtgaatcaaaaatataagggagttttataagatgtcttttaaggccttactgctctaacagtataccctgaaaaagggggtgggggaaacatttcacagttgcttggactagaaggttgtcatgtgactccaatgagatcaaggacatgaaggctcctttatgagtaaccacataggagggagtccatattacaccaggaagcccattcccatctaaaaacagcaatgtctattagaattagaaggcttttctttaaactgaacccaaatctatgtcctgggaacttccaccttctggccctggcattgacttccatggtcctccttcctaggaaacagtgtcagctctccccattgtcccatcccctactcaccctgttcttacctaggccaaacttccccagtttcttcatctatttaacatgtgacatagcttcaaggcccctacccatgtctagctgcttttctttgaacatgctccaagttataaatgtccagtgaccaggccaaaagaggctttccagctgtgcccctataaatatagtcctggaaagctgactttccctcttttagaagcctacaccacacccaaggtacacacatacgtagtcataaacacacccataacatacacattaccacacctatgcatgcccatttgcaaagccacgaacacacacacacacgcttcacatgcaccacatactttccacacacaacacaatatactcacatcacctgtgtatgcaccactcacaaatcccatgcacagccacacagttcacacaaagactttattcacattgaattactttcaacgaaagctactctttttccttaagtaaacccaagttctttttggagtctccattctgtatttggtgtttgaactcaagtgtaagaccttatattcgctgctgcatttctagtctggtggtacctgttccccaacatacccctgcagcacaccactgcctacatcagctctattactcaaacaacagcagctgatatatgtgaagctcttcccaaatgttgggcccttaggctcaattgcttacatgtataatctcacttaagtcacagggcatcactttgaaataaataatctttgggtagttttttgactgggcaacagctcatttcattgcactccccctgagaaatgctgtacaatgtgaagggtaactttgtgggtaactattgatattctgcagggctataattgctttggtgcctccctttgaatgtccttcagaagtcttcaggagtcagagatggggttgggggaggaagctgtcagctgactggacagaactggggcagtatctaaatgttccttcacccccattccccttgcccaagagatagctggcatgtgacagcaattttttttttgaggggcaggtttattttgtcttcattagaatatcatcactcttttgttgatgtttgctatttttttttttgttcaactcttttttaaaaaaatttactttaagttctgggatacatgtgcagaacgtgcaggtttgttacataggtatacatgtgccacgttggtttgcatcagagagatttttcagggcgacaacgggcaatgggcaaccataggaaggcacttgggagaggcatcactgaggtctgggaggaatgagggcccagaaaggccttctttcccagggaaagagacagcacaattgacccacttgaaattctctccccagttcactcttggcattggatttggcctcaaacaattggacttctgtaaagcagccaaagctctaaagctgaagggaccctggggcgcactttacatacaaatttgatcttttcttggagatgggaccgaatcgatttgctgaggccaggcctagttgtgctgcagcaggatcagtttccaaagctggggcgtgactgccaatgagaccaatgagacaccccattctccaagtcaggtcgtcagataagcacccccattcaccaatggcaggacttccccaattttctttattacttgtttgtacctcaaaatacatttctcccaaagaaaaaaaatgtgatgctctagagcttagcccataccttacccatcgtgaggataaaatacagaatctgtgtgatgaaaactggcagaaaataatactcttgcaaatatatctcaggctccagcagtagagctgacatttatcaggcttaaatatcaaatgatggaaagcattgagcactgatacagcaaggcaccaggtccgtgagggtgattatggcaatggtgaaagtaacatcattccttttttttcacacctacctactacaacaacctaaatgtccaacaatagtggaatggttaaataaattctgtgatatatccccttattagattgcacagaatcataaaaattgtttttgtgaagaatatgtaacaacatagaaaatggtatgattgtaactgtcaaatatgcatttttgaaagactagaaagaaatcgacaataagataaagttagagaatctattaaggtggtgggataatagttatttttctctatgttttctaaagtctatgaagtttgttcttcaattactgttataatttaaaaaggcatacaagggtaaatttagtacctgtgatatgcaaataatctatacagtgatctagaatttcactatacatagtttaaagaattttttctcctaattttagtttaaatgtaatgactagatccggccagccaaccatgatcttcccaatgatcatgaaatttccactaactctgggtgggaagaggaacaactggtttgaatcccaggccagctcttataaggttgctgtgagagagttacttaacctctcttaaaatgacataataatgtctatattttggggttgtaaataataataatagttcttattactgctgttgtagatgtcattatgttaaatgctttctatggctcagttatcaaaagaagcttttttcccaaatgtttactatttgtaaataccagtcatactacataaactatctctaaccataacaactttctgaggttagtattattgtctctattttaaggacaaaatctcagagaagtttagtaacttgcccactgtcacacagtggctgagcagggattacaatcctttttgatctgacttcgaagcttgagtgaaattaaaagagagaaacatttgcaaaactcctatgctgacatatggcagacatttactaggtggtcaacatgatgttggtgatactttgcccaggacccagatgctggtctttgacttatttgattatctataaatttctttctgtgaaaaggaatttcaactgaaagatgcaatacaaacgcaccacctgtgtcctcatagatgtggctctgagtcactaagaaacgatttctgtttccttcggcagtatcatttgttctcacatgtatcagcagaagtaggtagatggcatgtttgatgagccttggcagctactgtcacgtctcagatacacttcctgagaaaccacgcggcttcctcgggatgagtactcaatactcagcagctggtaggtccctgcttattaaggaaacttactaagtggcatgggcatatctggaacccctgctctaactattctctgtctgatgtggttgacacctaattgctacccctcccatttcccttttcaaagctaaggctccaggatttccacagaagcatacaggggtaggagctggagaagtttttcgaaattcttaaatcctcagagggactcacttgcaaggaggaatctagggttagtgaaggtagcatgcaggataaatagaagggatgaaggagagggaggagttgaaggcaccttccagagtctgggaacatctaggggtggacctctcagagcttttcctgccatgaatctcaatacctctctactctgtagtctctttatccctccctgggattatatccaccaccaccacccctcccccgcccccaatttcttgatcttccaccaccgctccctgcttaaatgcagctttagcttgcagtgacttgcttttgtctctagagggaggcaaaagcaccagggaggagggggttcagattggggtcttcttccacttcactagttttggcaaagagtagaatttattttcctttcattgggaacatatgaataaaagctaatcagagatgtattttaagtgctgcatagcatatctcagagaaccatcatatctttctctatcattccatctacccctcaacgtaggtggctgctagaaactggatggtcttaggcactattatttctagagtgaaagtgagggcaaagcaaaacaggagtcatagggcaatcttagccaggaaatagtcatgcttttattttctggggcacaatggcacatatttaggagactgggttggggctgggtcagcaattggggtggagggaagtctggacagtgagcagaaagtttgaaactttcctgtgtggagtattacatctgaaaccttggtctcattaacactgcgaggagaaactgcagagtgagaattggacttaaggtccagttcttccggggctgcattaggctgatcaaacatcttcctaaaagaagagggactatttcaagagtgtcagacaagccagtaatgaggaaaattggcagtttagtcagttggctccactccctgaacaccatggttgagacactctgggctacatgagaacgaaaaaaagtgcagaagggaattaactaaccttttcttaaacatttactgtatctgttaaccacttggctggtggtttctatggtttacctcctttagtcatctgagcaattctaggcaggtgttaacatctccattttacagttgaggaaactgaggctcagagaggtgaagtatccttcccaagatcacacagcaagtaagtgctcgagctgggataccaacacaaagctgtctcattccgaagcctgtggtctttctctgccctccccacatggaaaaaacaaaagccctgattttcaagggctttactctcatggggaaaccatgatctctctccccacaaaaatccacattttggtgccctgctcctccagattcttatatttagggtgaaatcaaacaaatctctgtttatattggacagtaatgggagttagtaaagcattttcacctttacaattccccatataatcttcatgttatgggaacacattttctgaactccaaagagagagagagacttatgacagcgattttaagctccaaggaagtgtgtgtgtgtttgtgtgtgtgtgtgtgtgtgtgtgtgtctgcgtgtctgtgtgtccatcccatggtggtggcatattgatagggattctgatagcccctcttattgccccaattatatgggtggggggcattagagaaggatagctttcaattattctaatagcccctggcccaggactgcatctttggagacatagcctggagcttttggcttcttcagagttgaagtttgtcttccattgcacaggcaggaacactgagctggagtgaaccagatggtctttatgaaccaaagtggaacttacacaacaggatttagatgggtagtctagcgatgtgtttatgcatttgtgcgtatgtgtgtgtgctggtgttgagaagcaggggcagaacctctgaggaagagaggcctcacatgaacagctgtgaggaggtggaagtgaagccagtatattcagaggagaatgaggaggtgtcagattggccccacagcagcaggaaagctgagcatctgagaccagatgctgggagataccaaagtttgcctgaacaccttgtatggatttaagtttaatgaaaccaaggggcttcaggtggtctatgccctgcctgagtaagactgacgtatttaggctccctttccccctccaaaggatactttctggctacataatactttaggcaatgctttctgtgcccacccaggatgaggtgctgacccaggcccagctggggggaagctttatggatgttccaactgcttttcatccacgcaccaggctcatttgtgccagatgaaagggcacaataataacagtggcaatttaaatcgtgcttctcactttccccctgaaaagtggcgaagtgactcaccactgttgaattgtccctctctatccaccccctgacctctttgcagcagtctaggctggttccctgggggctaagctgggagctagagcttccagaggccctttagctgtgactgggatgacatcatgcccccccataaatgtgttccccaaaatgcgatgtattgctttaatttgggtttctcagatgaggctgcttggaaggcattagagcagcatgagccccattaggcaagtgcagtgccccccgactcatgaataatataaaatggggtccattcagtaatcttttctgagggagaggctctgcttgtttttctacatgcagtttggtatgcagatgcttgctctatttgaaattcgccatataccaacttctggtagtgatattgtaaaaatgggtctgggggagctgtgaaatcattctgttactccaccctgattcttcacctccatttccctccatacccaaatcccctgaccctgtggctagaaaatgttcattttcaactctttctttcagcaccagcctacggagagctcccagaactggagctagtgaggtgcacttgtgcctagagtaattacagattttgaagtatcaacaaagcaggtaattaggtggagaaagtatccgctgtctgggagacaaagacagtaattatgatgagtactcttggtgctgtcagtaaactcaaaagaaagatttgtagagaaatgataatgtttgatagaaacttcaatgtctagcaggaatcaggggactcttagtaaagccacctggtatgtaatacaggtttaggaaatatggtagacctgagttcaaataccagctcagcctcctagggtctgtgtgatcttggggaaattacttaactactctgagcctgatgtatgaagtgtaaaaatagcaataattatagctctgtctaccttacaggatcattgtaaggacccaaggagataatgcatgtcagaacacttagcacaatgcccagtacacagtaggtacttaacaaatggcaacattattattattattacaactatccttgctacataccaggtattctctacagccgttcagagtttaaaaagggaaagaaatgattgcagttatgtatgatcatggcatgagaagtatgaagggtgtaattgtggtggctcaaagaagcgagccctcagttgagagggaaaagtacagaagagcagagaaagttttgtgattctggagttaggtttaaaaaaaataagtaggagtttgtcacaaggcccaaggggaaagggcttccaggcaactggatctgcccacacaaagccaaaaaggtgtgaaacagccaggccctgagcaaatagttgggctcagctaggcaccagctgggatctcctgggcgggggaggggtgtcaggtcagagaccaagaatctttccagcttactcccaccagcccctgtatcgcgccctaggcgccctacctggccaatcacgtgcggtgccctcctcttctttcctttaagcagccaggtacattcacaccctgccccagcgggccttgccgacacagaggtgggcgggcaggcgaacccccacggtgaagatcagaccagcgggaacccctgccggggtcgcggcccctacttcctttcttctctcagtcccagcccaacgtcccactcgtccccgcccccaaccacacacacggtcacttgggttcttttagacaaccctgtactctcacacaccgcacccatacacttacgcggcaatcccccttcaagacacacacaaccccttcatccaagcacgtaagctgaccacatgcgtccacaccacacacatgagaacatcacaccaaaagacacacaccgcaccctcacatgcataaacctttgaacacacatctcaagtagattgacttatagagaaatcttgcacacgcacacattcacacactacacagttcaacagacaccacctgtaaacccacattgacacactgcatctaagcataaacacactccacacatatgcacacaagcttcaacgggcacacacacatccacacattgcacacacatatacactcaccacagcacgaccacaaaccccggcaggaacagcacacacccaccttcaaaccgcacccacataatcccactataatcgggcagaaacatacaacctataagcgtgcacacacaaacacatgctgcatgtcaaagcgcaaaccaaatacacaccacaccaagcactccagctaaaacgtgctccgcgcacacaccccccacacccggccacacaccgaacgcacacacagatctaccgcacccgcgcgcgcgcacacacgcttacatgcatacatacatacatacacagcccgcccccgccttccctttgggcggaagagaagggggcgaggaggagaggaggggaaaaaaggaggggggatgagcgagccaggcggggcgggcacagatgctcttttccttttgacctggggtgttgcccccatgttccccattcccaagcaaagggagtaagtgagttggatccaaggaaaatccaggcggaacccaggaaaacaagaaggtctagggaatcagcgagctggcgcgaggtctccgcggggaccctgactcagcgcactgtcgaccccgccggaggctcctcctcccagtaccctccccctggccctttcactgccttgacctctgtccccctccgcacccccaccctcagccaggacatgtgcttctctccccggcccccacccgcccccaccccccgagccccactggagagaactggccactgttaagggttgagggctttattggtttcaagaagtaaggagttaagactggcagacaagctttttgcgaagcctgttctaatctagcttgaagacttttcttaatggagagctcactctttctcaaagcatcacattttctacgtaaagggcaatggctattagaaatccccgaccccgcgctggacacatagtagggctctctaaatgttcccccctcccgcttatgtcaccacatttggcaaggctgtctgcagcctagcactggctcgcaacagctgttgggcagtcagtcggtgagctcttttcttagcccactagccctcctgaaaacagcagcttcggactgggcgccacaggcggcagggggcgatagagtcgctaacggtgctttgcacttctggttctggccgcacagcccctgtgagaatctctgaggtgccctcccgccataagcggactatgcgagtggtggcggcgggggtcactccggaatgatccgcggccagatgactttctggctcctgtcctccacttgcttcttttctgtggagatggacagcaagggaaagggagatggacctccccctccgactaccccgtggcgcattatgtaaagtgtcatgtaaaaatacccaggcttcagagttctttataggttcgaatcccagctctgccacttcttagctgactaacgtggtaagtcgctggcttaggtcgcggggtagttgtgaggcttagaggaagtaacatatgtgaagtacttcttccagttaacatacagaggatgtccattccctccctctttcccccaccctcttcaaaaatataaagatatgggagtttaaaagaaaggggattagagtctggcaggggggacatggccaccagctgatgctcccaagccaggccagaaacacagaggacgggcaggagttcagttaacttgcaatatgctgtatttaagggaaatgcctgcaccaatgatttggtgatgccattcactggccacaagagaatccaggtcacaactccaatccttggatttgtgatgaggctgttctgcccatcacctcccctccttacaaggacttcctaactcacctccacttgtattcttttccttcttacagagatgccacagtaatatttttaaacttcttgtgagcactccttgggtgccaggaatgtctcctgttaacttatgtcccagcagcatctagcgctgtgccagacacacagtgcaagcgctatacaggcggcaagagatgtcctgggtgaaatccctaggaaacattgagactcgagggtacatgaggagttatcataaggaacctaaagagaggaccctaggcactgcagggatggagggcagtggctttggataaagagttattccattggacaaagagttattccattggacaaagagttattccattcctcctcaaagccctccacctctaagcctgtctggaagagcattgcttcactgcggctgaggcttctgcaggcaactaagaagaaagcctctttcctggagggcagaggccctggccagctagagggtgattcaccatctcagttaggtagcagagatggcgctaaagtggcaatgaatcagtccaagatggcatgaggagattacctgagtgatgatgagaagggggatgaggcaggagcctgagcccttgaggctgggactgagtgatagaacgtctatattcatatgcacaaagtcagctcctaacctgcctccccagttccacaaccaagtccccaaggatagcattggcacactcctggggaggggaatgtttgggagacttgggttccaatcctgactctgctacttactatgtgactttgggcaagttattttcccctctctgggcttcagtggcaaggtaagtgctaggtacttcacctatgtcatttcacacattcctctccacggtattattggagcactaattttcctattttgcagttgagaaaactgaggctgagtgatattttgttatctaccttctctctatatcatgcggtctttgtgtatgtatgttaccaggcaatcgctgtaatccaggcctcttctagtatgccagtcctctatttaaattggatccctatgtactcaggttcaaatcgtgtctcccagctgcccccaataccagcccatgttgctagttacctgggtgggttttcttttcctctccggcgacaccctctcccacctcaactcaagtttttttcctggcatataggtctaaaatctcacattaaaaagcaagcgtcaccagaaagacgtactccaatgttttgtgttttatcacagtggagggtgctggttgcagggtgctggttgcaggatgctgcagtgaggaaggggagcagagcttccagggccagagggaggggctgcagaaaaatccagggagagagagaagacagagagagagagagagagacagagacagagacagagagagacagagaaagaggggatgccagggacaaattggaccagcctcaaactgctgctccctccctttctccccctctacttacctggtgctctagaatgtataaaggggcagcacccagtccacttacagcaggaggagagggagaggtcctctcctctcctctccttcaatggaagggcaaattgtcctgagtattcaaattgtactcctgtgttgggtaagatttatttaattctggggggaggggagggcgagggcctcatcatggtagcaatgatggtgaggtggcacttaaattgaaaagagcaccaccagtgctgcttagagccagacgctctctctctttactagaggataagtgaaacttgacactgggcttctggatcttatttccaatccaggcacctaagagtcatatctctgagcctttggagaataagtccatgtctgcctgggcttccacagcagctatacttggagccagcagctgtactctatcctttcccttcctttttcttccttctctcctttgcccaggctctgcttccccatgtttccctcttgctgggctcacccatagtctcttatattcttgactcttctctttcttctccatttctgtccctctttgttgacaacactgtcccttgtgcatttacttggcccaagacaggagagaattcaattggggggggtgtaattgtgtatttgaaattctcccacttaagatcttgtgattataaccccatattgcccttgttgcatcagataagaatattaagctcttgtaaattatatatttttgcttggttgaatggtgatttgtatatatgattggtgggctgcagtttagaagagagtatttttggaagaggtattaaaaggtaagatggtttgggctggtgtagatggcctcctgacttctctaagtgcctagatatgcaaagaagacagtacatgaaaaattaagactatagtagtggggggcaggggtgggagaccattgccagccaggtcgatggaggactttgtgaagtcagcttctgttttgctcttgctgatcattgaactttgaaaaaaatgacctttttatctctgagtttggaagaccagaggccctagacaagaagaccagaggccctagacaggaaggggaaacaaaaagcagaaagagtgaggcaaggaggggaaaggactattccttgtgcagtccttgtgtgcaaagggccaacaaagaatgtcccctgccctcaaatgccacaccagtcaaggcagaagggaagcaaagtgctgtggcaaattgtgtgctgagctgggatccaggagttctggaccttcatcttggctctgccactaattagctgtgtccttgggtaagtttcttaaccatctgaacctccatttctgctcttccttcacttgtactgtgagattgtgtggcatggccaggggaggggaggttcagagcattcagagggaagggacccttgggctgaatcttgaaggagagctctgctttgaataggggagagaagattgtggggtacagtgagaaccagtgggagtggcccagagaattcagcaaacaggtatacgtaaggcactgagctggctgctgggtagaaaattgctatgaatcagccccctcctcaccgcggcaagctttccagagagtaggggaatctgagaggcagagccaagcgctggcagtgcctgcagctcctctcagcactacccgctgccgcccgccggactgtcgagcaggtcacgcagcctttccctggccggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatcccatctagaagtgtgcttcctgctgacagtgggtgagtacccattttcatcttcaaaggatgatacagaggcattcttcagcaggggacactatctgcctcattccagatagtagcacttctgctaagtcttcctctcaagtttggctcccaggtattttggagggcaattcctcaccttgcttgtttgcttgcttggcatagaaatgtaccctttggagaacactttcattctacccttttattttatcttcacagccacacttaataggtaccatgattcttgttttgtaaggtcatggatctgaggctcagaaaagcaagataatttgctctctgtcacatagttagtgagtgtgtaaacttacatggagtgaagctgggatttgaagctaagttccagtctatatcacaggaccttgccaggataccatgctgtcaggttgggggtgggctggggtaagaaatatggtgagatgcctacacagggcttttggtgtctttctcctctgtcaactcctctcctctacctttcataatagtcttttttttccaaaaacatatatatactcttcctgtaaatatatatatacacacacacatatataaacacacacacacgcatatatatgtgtgtatatatatgtgtgtgtgtgtgtgtgtgtgtgtgtgtccatgtatctatctttctttctatcttcatttcccacggaatggcacagagcaatgtataaaaataatacctcaaaaatccaaccacatccttaggaaagaaggtagtcttggtttagactttcccagttccaggcagcagatgttggtggtgaataccaagaactgctatggtttggtggaaagggcaaggcttgagttggggataggaagggagagctggttcccagatcatattcctccatggcatttttgtgcaactttagataagtcacagcctctccaaagtcttagtttgttgctattgtaaaatggggaggaaatatccaacctacctctttcccaggggttattgtaagaataaagtggcatgattcatttattcatgaatcacgaatagctgttttaattacaagactctcaagagcttataatcctgtgattcactcgacaaacacttattgaacatctattgtgtgctagggtctggagataatgggcatatggaaagcttttaagaaaatgaaaagcaggagacaaattaggcattaaaaacttttacctcctattgatagaacattttatttttaacttcttccaccacaatttaatagaagcagcaaccaaaaggggaaaaaatgatatgcatgacacagcttgtgatgccaacactattatgcaccctgatacatattgcagataatagtgagaatatctgtatcttcgtgtacttgatgtcacattgccttgtttacactatcctttgggatgtttatagcataaaaattgcctttcaccatcctgagcctgagttgtttctttagtcaataaaatttaaaaacaggattccatggaatgacgactgtacttattttacaaagatgctgtaatatgtggtggctgcctgccgtcagatatgacctaccctggcttatggaatcaggctttgattatgtgtattcttttgatttctttatttagcaatgcagaatcttgcagctagtgaaagcaagtatgggtgcgtcaatggcaagagccctgagactgaagagaactgggttcttgtccaagctctgttgtcaaattgctgtgtggtcttgggaaaacccctgtctctctgtgagcctcagttttctgacctgtataatggaggtttgggaccaggtgatggctaaggtcctatttctgaaacattctaatattataatgtttctgaaactttcttatttttttgaagccagggcttttctccatatattttaacagtaatattacctctagtttatgaccttctgctataacatgatgggctgactcaatgtattgatgaacactatccccagatttaattatcttggagcgtcatcaccacattgtataaaatgagccatattgttcattgcatcagcagcctttgctgaaatggaggttatgggataacaactttaaggctaactcattaatgctctgggatgaataagctaatgtgtcagcagaccaaactggtgcccaaatgttttcgtatagagacccatatctctttcccatgttgtgatacattaatggggatgtctttatccattgccgctgcctgtagtcatttgaataatgtagatgcagtaccttctgggcacccagccccattcactatcaatttcctaaactttgaggcactctcagaggcttggaccaaaattctagtgatgccatagagtacctaatttataaggatttaaaccatggcatcagtgcagtccctgcttttttttttccataggtgtttactagtaagcactgcaccattcttaactattttatgggggtaatggagtaaattagtcctccaaatcatgaaggctgtagatttatgcctagttgaaaccatttcagtcctcacaatgttgaagtgggtaacctttctgacgttaatttgtttctccatctgtgtgccatgcattttgggaggacgtgagaaacaggcttgatgccattcaagtgtgtttcccctttttgtattgatggaaacttgatttgtgcctgtccgctctttgttcaaattctctctcttgatatctgctcatattctagcccctttacttatccaaataaaatcatatatatatatatatatatatatatatatatatatatatattgctagtgacaatgtagaattggatggcttgaaagagaaacaaattttgagacatacaggcactttattaatctgaataataacatttgaaatattaacctatgcagttagtttttctaaattttataaaatgttttttttaaatacttgactctgctgaaattggagaatgaagaagaaagatatatcccttaaaatctcctaagatctctttacataattcaaatttagtggagaagagtagattgttcaatggattgatacaaattctaattttatgtaattacttttgaaacatgattttttttgtaaactccagccctctgcaaagaaccttcactattaacatgtttattaaaaaccaatgctaaataccacacataatattattcattcaactctcagacaaccactgaaatggatactgtgtcatttcaccattttatagagaaggccactgagactcagagaattcaactgactttcttaagatcacacagctaagaaatctagaggctggctttgaactcagttatatttggctctaacactagtaaaagtatttgtctaaagatagtgtttctgcaaatgttttgaattctagactgaaactgagctggtttgctttcatcttgcttttgaatctcatggtctcttcaggctagtgccatggtatactgaaggggtaaggggaaaacactttggagcaagagaggtctcttggcacctctttcctgtagggagcctccttttgtgttcagcttgaaatgtcaggcctgaagtattcaaatctcaagatcctgttatgtgcctctctcatagtgcgaaagcctgcctactcattccccctccccaccccacccatctgcttcttgtctggggacattggtcttcctaaatctgcttctgtattgtatgctactggcaccttgagaaggttgaaagcaagtaaggcaatgccaatttttctgttagaactgcagcatataactgctcttaagtttagccctgtgtgctggagcagggaggcaatgacaaacggtttattctaaggcctttgatttccttcggaattgtaagcatctaggctgactcatctctcaaaggcttttctctctctctccttttggggctgttgttgattggggattttactgtttgttcttaccttatatttgggggagagaagggactgattttcatcttatttttgggtgaaaaaaccagctctgctctttggatgatcagatctggtaagcttcgataagaagaaatagctgaaactccaaaacaggtacaaaagatatctggattggggaaaggggagaggggagtaatgttagagaaattaagccagagctaggctgtgtgtctcaggatgagaccctagactaataggctctggacctgctattttgaatggggaattgctagaggcttagtctggaactgtggttaaatgcatgtgcctttggttaaaatggtcactttgcaagttgcagtttggtggttggggttaggtgttcactttgggtccaggggatggagctttgcagttgaaggtttaatatctatgctaggtgttttcctcttggtttagttcaaaagccacaggaaaactcctcatcttttctcttactgcacctatttctgacatctgtgatcctggctactaagggaagtaggcaaaagagttttggagacaaaattcaagtatggtttatttgtttgtttgttttttgttttttgttttttgtttttttttttttggacagaaggtagctcatctatttagattattgcatgataaaccgttacttaacttttctctgccaaagctgcattgcctgatctttgaaatttaagctccccaccccccaaatcatatatagaatgttattgtagattccatgggaaagagacattcagtaaagttgtatgtaactacttcctttcttggcaaaaggtttagttccccatctcctgaattatcttctctatcaggaaccagccatatttacccaaaccatgaacttgggagctatcctaaattgttttctttccattgcaattaaagatgttccctaagccctgtcagttccatccatgagattcgtcccctactccagccctagtgacactgacttgtgtcaatatcccttgcctcttggctcatctacctacttccagctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtgcgtcaggtaaattggctatgtttacatgtttgttcctccaataagaaagagcaggaggaggtggggtttccccatagacctgactacctggtggggggaggagcagggtcttctttgtagcccccaggcccaccatattgccagctacctccactgaatactggaacctgttgaaggaatgaccaagatggagctgtggtgggccaggcagacagtccctgtcttctccttttcctagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaagtgagtcttctgacctccctagtagggcaaggaaaggaaatattactggggtctagggggttctagggacagagctcaggctggaggactttgaagaactaaggcaaaatgaccataagaagattttaaaaacctctccagaatatatacaattattatttgtcaattaaaaataaaattttaataaaaaacttatttgggttactttctttgtatttctaaatgttccattataagtctgttgcttggaaatttctctagagcttcttgaagatgtgtgtgccctctcaggtcaaaaaaaaaaaaaaccacccaggttctgtagaggaggtctggtttttatgggggcacttcttgctttcagagttcctgagctcaaatgctttggaaatgagcaaaggcaagatgcctgggtactttctccataactgccagcaagtttcaagcagaatctcacctcccttggtatcagtctgcagccaagactatccccctgagacagcccctgttttccttcttctagctttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtaaaaagatcttggaaagagtagtgaaaactgtagtaggggacatatgtgggagtatatcagcaagagggtggatggagaggagagagagaaacaagaataaaaagagacatattcatttgtacaactcccagtactacctcagcgtcaatcactttctgctttcctttgcctaggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtaggtgcaagttttggatgcacttgttttacacatccatctcctgttcacaaggcaaggcacagttgtacctgcatctttgagggtagccaaaacaggcagccacaagatcgtccagtctagaaattcctcccacattagctggccctggtacctttagtcctaggtacctgaaagagatgagtataaatgaaaaggtgctgtgtaatgatggctaatgttgctaattctaccctcaggtgcctccccatattcagaggcaggttgctaagcgcgtgtggaagtccagcccggaagcacttgattttatcagacgcaggaacttgaggaagatccagtgagtgttttttgggtttgtttatgcttagcctgaagtacctcctcctatggggttttccaactccagactatctttatattaagtaacgcaagtacacaaactgactttttcaaaatccttcccattcaggagtgcacgcataaagatggaagaggatgcactactttctgatccagtggaaacctctgctgaagcccgggctgctgtccttgctcaaagcaagccttctgatgaaggtcagttccctgctggaggtcaggcccttgctgaaggtcagtcccttgttgaaggtcaggccctttttgaaggccaggtcgttgctgaagatgagccccttgaggaagatgagtcctctgaggaagatgaagagctagtatttgaatatcttaatcaaggagtagtctttggggaagctcaaggtctagaaatcccaaataactttgagattcagggcccacatcttgaaggaataccagagcttgatgaggaagatgatgatgatgataatgatactttaaattttgatgatcttcctccccttggagatattctagaaccagataatgaaattccagaactcattgagatcccagactttgaagaaattccatattttgatatggtcccagaccttgaaggagccccagatgtgcaagaaatcctgaaccctggagaaaactcaaaccatgacctagaagaaggagcagattttgaagaccaccaaaatcttaaccttgcagaagctccctatcttgatgtaatcccaaacaatgaaatcccagaccacgcagatgcttcagataatgatgaaatccaagattctgaagaagatcccagtcttgaagatgtcccagctgttgatgaagttccaaatgatgaagcctcaaatactgaagaaatcccagactatgaagccccagaggtaaatgggatttcagactctgaggaagaccttgattttgaagaagtctcagctctttatgtggttccaagccctgaagaagcccctggtggacatgaaatcccaaatcatgaagaatctccagaggttagtggactctcagaccctgaagaagatcccagtcttgaagaggtctcagattttgatggaatcccaaaatgatgaggaagcctcagacactgaagaaattccagaccatgaagaagctccagagaccaatggaattgcaggccctgaagaggtcccagctctccatgtagtcacaggccctgaaaatgtctctgattttgatgaaatgcaagaccatgaagaatcctcagatgtgagtggagtcccaaacaccgaagaagcctcagatattgaagaaattccgggacgtgaagaagcctctgatgttagtggaaaccaagactctgaagaaagccctagtcttgaagaagattcagttctctatgtggctccaaaacctaaggatgcccagatttacaacaaagttcaagattatcagaaagaccaagccagtgcatttgaagaagaagaagttaccactatggctccagaaactgatgatgtctccattctcaatacaattccagaccctccacaagacctggctgtcaatcttgaagaagtcatggatgtggaagaagtcccaatgcctaaagatttaaactctaaagaggttcagaatccaaaggcaattcagtttcataaagatgcagatgttgcattccctgtagataccactctccttaaaaacaagtctcagcctggccaagtcatggactacaagtcctcaccagaggtgttgaagggcaacacctgctttctgtcttccatgcagtgctgtaagctttcagctctagctttgttactcatttgcttggtaaaattagtcaggttacttgtagggtggtggtggttattaggaggtcgccctcttacctgtctccctggtggtattgtccattccctctgagcgcagggtatctgtcttactctttctctttcctaactcagctcttttcccagttcccacagtggtcctagattcagagatctgtgttctgctgtcaggctgtagtattcttatatgtcaaatggggataatcatccctgtcctaccttcttgcctcatactgtatttgaaactcaaaattaggtcttagtgccttgggtgctgcgcaaagtataaagtctagaaacataaggagttaacattgttactatttttcaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagc

SEQ ID NO: 3705 - DNA, 41677 bp, human; identical to SEQ ID NO: 3702

SEQ ID NO: 3706 - DNA, 49972 bp, human
atgctacatttaaaagtgcagtttttggatgattcccagaagatttttgtggttgatgtaagtggaaatcacattgctattattcctttattattcattcaataattgtcatttgtgaacagcccattagagagcaatgttatgtcttctttaggactgaatgaaggaggactgtgatttttagctttggaaaaataatctgtatttaacatcacaatgtagttcatatttttccattaacctttctcttagaacaagttgtcttttctcaagggacaacaatagcaaattttaaagacaggataactatttgcaaaaagtaaagcagcaataaactagttcttttacccaataaggtattgttgttcattgaaattatgtctgtgggtctcaccccatgagcatttgtggggagaaaactgttgttctgagggaaaggagtgggggaagctatcctccttttctgaagaaaacctatgggttataaggggtagaattatgtagttgtaatgagaacttcaggaaggaatgacaagtatgagagagaaaaataggataagagactatttagtttgatttagtacttatagttcagagttcttaataaattcctagctacaagatgattgcatacaattatacctcatctcttcaagaaagaacaaatgtattaagcacatcatttggtgctcatgttccaacatcttaagatatgtacattttgatgtcaggatttatgtatgagcattttgaaaagttctacatttttattggaaccaaaaatgctatttgctctgatatttacattagccactaacaagagacaaatagtttattttctctgaaattcatacaaaatgttggtttttttcttttatacataaactgacaactgctgtggctcagccatgatgttgtgtgtgtgggtagcccatttttccaatgagtattttatttttatttgaatcatgtgctttgtgagtgatgacttcatgtcttcatctgctgttttgctgtctcttcctttcagttttatgcgcaaaaggcatttctagttccacggacctgaatgatttgtttttgtagcaaatagcttccattagaggtatgaggcatttcctattctttcttggaactatatttaaggggtggaaaatatcttttgagtagtttatccatttgcagactggtggtgtatgctcacagtgctgcagtacctgaattagtgagctgggtattcaaaagatattgctttaggctaagtttttaatagatatttcaaggaactcaaagagaaatctttgacaaaaagtgacagaagagtttgttgaatgtgcagtctaattcagatccatttaaatggggtggagggtgggtaaggaacacagtaccatatcttcacaaaattcacctacggaagagccacttccagcaactagaagacttgatttggcttcaagtcaaactgtctctttccagctgcaacacattgtgttccttggaaagataatgggagagatttgatacccagcaattcaggtgtcaaagcatgtgatcccttttgctctgtggaagaatgctttgtaagtagcaaccatggtgttacccagagaggcaatagcattggctgcagtactgtgagtggctttgtccagaggagttagaagcttaagttagcattcaatcatccaatagtaccttctctgcttaacaataatagattgatgatgatgatgatgatgatgatagtgatgatgatgataatggtggtgatgatgatgatagcagtagtgagtcatctgtggatagcactttaaaatttacaaagcactttcacatccattagttcatttgatcttccattcagccttgtgagtgaaggtagggaaaagatcttttcccattttgtaagttaaaagatggaggctcagggaacttaagtgacgtgtgcacaatcacacagcatataattgcagagctggacttccaatccagaactctcccctctccttcatatacaattgtaaacagtagactcatctgtcagtagccttcagtattgccgatgcacattatttattttctgatgacctcacaaggcatagaacttggcacacagtgagcttttgatgactattgtgaaccagttagtagacccttcttttcttaatcatggttgaagaattatgtgggacagtgttccctcaaggtcagggagacaatggtgtgaatcttttcacctattcaaacacttaaaaaagcaacctaaagaatgctctattttattagtactaacattccaaatttgatgaagaaatgcttggaaccataatgaagagaacccattgatagctgaggaaggccacatggaggaccttttgatactaaactgaaatctcaagaggcatggatcataaccagggaaaattgtccttcaagataagattcaagaaaataattggttgcataagggaacatagtggactcttgggtattggtgttgattttatagaaagtgcagtggtagaaatataaaaaggacacatgatcagataaaataatgtcacctggagaaagctcattgacatccagaaccctttctccacccccagtactattatcttcctgaatttgccagtgtccaaggtctaactcaggcctcctgactaagaagcctgttttgtcactactccacaagaactggagtcagagactgacatttaaaattagaatgctagtgtcaccatttacagtgggattggggacactggggtcctctcatcatttatatgccaaatgatgtcagaagagccagatctggaagaattagatatatgatcctaatattcgatggcttggtaatgcatctgtgtccacagaggccatggcattgagaccttttagtcacgtattcattaattaactcatttagttaacaaattattattgaggacctaatatgtcccaggcccagttctgggaacagtagactctgctatattggtaggtaaagttcgtgagcaagagcacactctggcctggacatactgcctggatgctaccaattttggccttggttattcctttttctgtcattgcatgattgacaactccgctttctgatcatcctactgtttttaacttgttaatactttcagttagtttattagaaagagtggctgctcccaaatacatcttgttttcctgaggtttctttgcatatttgtgctctgagtcacttggtgttgattttatagataaattctctgaaaatattagtcaaccttttctttcatgaacttccaatagtgtttaggggtgcaggataggttatgggacttcacaattgctagaatgtgcctactaaagtacaatccaatgaagaaaatgaatttagtgaaaatgtcatcttacttttcaagccctcatatttatttcataaactgatcattgtcaaatattagcattattcttagggctgatcttacaacggacagcttatctttagactgtcaaggaaggctctctagaatgatgatgggagtgggtgagtgagactaaaaattgaataaggtcatgatttacaaattaattgcaggttttattgtatatttggttttgcttcttcaacatggagactagaacttttcttgaaggaaaaaaggaagataagaccaaagttaaagctttgtgagatattagaaacaatagagggtcaagtttctagcttgactatcaatctcttcaatatacacacatgcacatgcatgtgtgcacacactctcacacacagtagtagtgatgagtgcctttggagagcaacctcttgtttgctcatctcaggttacatagagagttgtacaaaatggtcatcccatcaccgtatttgacacagttctatctgatatccctttttgcctgctgcatttctgtctttgtaaaagctgttatttctgaatttccaaaatgatgtttcactttgatggtttctggagactaaagtcaaaacgagatgttaaaacatctctactttcacatttacctgattgctaagtgattgtactggccatgcagtgggtacccagtaacagaatatagtaagttagctcacctgattcccttgggagcccatgataaaggccactaggcctcatttttggaaagagacagagaggcagtgccaggaccgaacactgttcaagttaagtaggaaagcaaagcacagtgatttttaaatttattagtggtggaatttacccttgggatgtttgcccaggggttggtttttaaatttgcgatgatgaaggatcttttgtagtttagtcaacagtgaaatagataactgattctgtcacttcataaggcaaagttcttccaacttcaatgatatgaaattgctttggtgtaatagaaggtacctggatttgggactacaaaaactaccaaaaaacccaccactttagctatgtaatcttggactaatcacttatccccttagcttgctgagttgttgcgaggagtaatacaaattaggtaatgtatatttggagtctgataaaccaggatagatttgactctgccactgacaagctgtggagccgtgggtaagtcacttaggctatttgagccttagttctgtcaactgtaaatcctagacttggggtgccaggaaaaacttccagaagaacaaaccatttaagttgctgagtaggagttaagaaggtgaagatcgagaggtagattgtgggggaagtatggtgatctacacaaagggaagaacgaaggccaatattcaagagaacatggtcctttcacagaacaaaagggtcaatctaagtgaagaatggagtattgaaaggaaaatggcagtgactggaggtcaaagttgaagaagaggttggcagctagacctttcaggcaatgtattctatatgtgaagaagtgtgagaagtgtggtctttatcctgaaggtggcagagaccactgaagggtttaaaagtggggacattagcctctgctcatcatgcattaatttatgcatttattcattcagactatatttaataaaaatatgttctaagtgctagagatgccaggtagaatctgaatgttaccatcaagtttagtggatccaattttagagggtcaaactatatccaaacacatatgcccaaacatcgatattgcagcctactagggttctgaacttcgtcaatggtgaagacagacaggaaggatgaataaaagacatgctaatgaggtagaatttctagaaccatttgatgccacacttttggatatgggagatatgtgagaaaggatctaaatgaccttcaagtttctagcttaagtggctggtgggatgatggccccattcaccaagatagagaacagaatagaaggagcaagtttagaagggataatgattggttttgtttgagatttatagatgggattatggaaggaaaaatacatctggagtagggcagacctgaattctagaccaaaccccaacaatttgaaggtgtgagacttcaggtgggtcacttcagctctctgaggatgtgcccttatcactaaagtggagatgatcctagcatctacctcatgagatcattgtcatgataaatgagatatcagggataaggttcctgacacaaagcgggtgctcaaatttgttaattcccctctccctggcttacagacctccttatttctgtactttgcaaaccaacaaagaacagtctttcactttcaactggactttcttttgatgatgcttgattttgcaacccacctccaggtaatagagctgtgctcccccatttctgcgcttcctgtagggttaatttaccctgcctttttgcatgctttggcctctgtttactcagcagccccaagagatttgctcttccctttggagtcattaatcctggaagggtccataagaactccctagagttacctaaaataatgtagggcttcctttaaggaagcagatggaaatagccaaaccctttgcattttactacattctaaattgttccatggtcattattcacagttagggtaatacagttaataataataacaataatattactgaataataatcacaaatagcatttatcaacaattttctagatgtatttcccatgcactaccttacataagtctcatgcacatcaaataagtgtcactgactagggtttttatataacttctctgtgccttgggtttttttttttaatctataaaatggggataatattagtacctgctccatagggtcctaacaaaggttaaatgaattaatatatgtaaaacactcagactagtactagaaagtgctatataagtgtttgctacactcatgcctcatggaattcactccaattttagatggtgaacacatgtcctgcttcttatgtccaagcagtaatactccaagctgactaggcctaaaatattatgtttatctctattttatgagtatgtgaactgaggcacagagaggttgacttacccaaagtcatatggctatttaagttaacaggtgagctgggattcaagccccactttgtctggcttcaaaatcctgtctggacattgattagatggtaggcttctgactcaagcgtgatttctgtatatgcagtgaaacttcctggttttccagaactttatgatgtatcctctagcagatacatcacaagcagcctgcctaaacagcctgccccatgctaggtgggatcaatcgatgtttgttgatagactgaccaacagactgagcagatcagctcaccaccaccccgtgcctgtacaaagaaagccaagtgaaggagcttctaaacccaggtcagaaagatcatcctggaatcataacgttccaatctagccaatgttggctgtccctttgccagggattcatttgtcattgcaggggacccatactgcttggtgaatgcctttgtttaaactgaacttcctctgtcgttcatatcctgaggtttgttgctttggagaataaattgaactgaaaaaaagtgcttgtgctttctctggccccaggccaggctgagcagtgggtcaagcatggtttgggtgctgcctgccccaccctctgggagccccacatctcctgctgtcacatggcttccaggctgctttcctgctccagttcagagcaaaggcagggcctccagccttcccactcccactcctacctgccccttggcttcccatccccacagctgaaaggaggagggaacccgaacgcaaaaacatttgaggccatggcggaagagattggggaactggctttggagctataggtgggtggcgtttggctgtttgttcaagtctgcactcgtgggaatctctgtggaaaatttcagttagtcggggccttgccgcctcttcacctttcatcgcagggcaggcctgcctgctgcctggtgctggggaggagtagcagaagttggttcactgccctgcagccagaacgatctgcagatcttccctccgaattagactcgccagagatgattcctctgaattctataggagtttctctctcccgcttttaaataccctgcatttgcatcattgttttgacctgtcacaaacacaaatgtattactctaataaaggcttaactttaatttgtgccttaggacaatgaagctgtcagttgcaacttggagaaattcttcaaactgactgagctgagtccaaattgtcttggggtcaaaagggcatggcctgagggggaaaatcatctgggaggcggctggactggcccagtcatttcctaaaagagcctggagactgccagcccagcagcagggagcagtgcctagcttttgtgatactaggtgcctcttagcagctttgtgccagactgtcagaactggaaaaacattccgtgagaccagttctactgctgagagaaccacccttaacagttcatttacaccccaggaggtagtgccgagctggccaatgaggtgctagggcaaggcaccactgagaagacctgctgaaggctacaaagctcaggaagaatgaaaggtgataggcgttccgaggaacatttttctgggggctgcggaactctctgatgtatatagcttgcctggttctaaacacagctgctgtgcaaaagctacaattattacccccacatcatctaatttcagcccctttttctgtattccttctcagcctctttacccacttcctcctcttctgggtccaaggtgtggggccagaaaggggaggtttggctgggtgagctgaccccaggccctggaagcacttaggcatggcgcttcaccactaatcgctgggcttagttgtcttaaacaagaggtcctttgtcctctgagattccttctatgatgacgaaattcacctttcaacagacttttaaaaagacaaagattctccagaacttcacactcagaacattttaagtgattgtaagagatctgtgacaaagttactgtcaattgcctttaatgctatgagatttcatttcctgacctagctgcatgccaggaacttccacttacattatttcatacaatcattacttaatacgtctgtgaaataggtatgattatgctccttcattcattcatcactcacttaacaagtcctcactgaatccacacactgtgttggctattgaggatgcagagatgaatgagaaatagtacctaatctcaaagagatcatgggctaggggaagaatcagagatataagcaggtatgtatattatggtgtgatgtgtacaaatgacagtggaaaggataatttttttttctagcacagcaaaagaggggcatctaacctagattgaagtgtgtatgtggaggggacggacaggcaaggtttttctaaggaaggtgatgtctaatctgaaccccagatagccagtactaattatttaggtatgtgttggggagttggggggctgtgggggagcagagatgaaggttggtccagacaaagggagaagcaggaaaaggcctgtggagtaggttaatctgattgaatcttaaacttgagggcagaggggactgagagagagcgatgagagactgagggctgagacaggagagacaagcaggaactgatgagacagctaaatgcccaggcagataaaaaggggtccccagagaatctctggcccactccacaagtgtttacatcagatgcttttgtgcagatgggggaacctgcccagtgccttgtctgagcatgcccacatgcgcactgggagaacagggtggagccatgggcagggggaggagcttggcctccagttcctgtgtggtggcctgggattcaatctgtgaggtcagggacctattagcaagagctccatctccctttgctgagtttttttttttcttttttcccttttttgcccaataaaatcctgccctactcactcttcaatgcgtctgcgtgcctaaattttcctggtcgtgtgacaagaacctggttttagctgaactaaggagcaaaattctgcaacacaaagtcataaaaaagatttttcaaataaagaaatcaaggttcagcaaggttaaatatgagctcaaggtcatacaactgcaagtaagtacttgagtcaggaattaaaagtagatgcgttcattccaatccccaactctctcccctatggtttgctgcctctggaattctgatgcacagtttgggttcatataattctttcactactttaccaagcaagaactaccactgccacgattccttcccataatttgtattcatatttccgtatttaattaaagttttacacaaaaaattattagacattttagtatttaattcaaagtctcaagcaaaaataagacaaccaaaaatgtaccccaaataagctgggaaaattcagtttctggaaaaatgtatcctaaggaaataaaattttatgtaaagatacatgtacatctttgtgtactaagatgtttattttagtgttgtttgcaatagctcaagggagaaaacaacttacatgtccaacaaggtagtttcatataacagtaactaatgatgatattcacaatataatactacatttttttaaaaaagttggtcaccaaaaggtgttattacatcacatgcattgagctttactctgtgatccttagattggctgtctcttgataggtgggattaggagtaccttatttcttcttgcttttctgtttcttttgttccctgctttttaaataagcatatattgcttttggaatgaggccaaaaaaacaaacaaaaaaagagaaaacaataaaagaatcttcattgaaaacacagttccaatgataagtatgtgaggtaaagcacgttacctcgatttagccattgcataatctgcatattttaaaacatcatgttgtacatgataaatacatataatttttattcatccattaaaaataataaataaaaacagttgctgtacatgatccactacctgcataagcaatcaaaagagggggttcttctcatgacggcagggccacactttcccagatgctcatagccacattatgtgatatgtataggttctaggcacttgctccaaaatatcaaccccattccctactagcctacaattattactcttttccaacctaaatagtaatggtaatagctaatatatatcaacagaatgtttattatgtgccagacactagtctaaatattttacatgtatcagctcattgaaatcctcaatgaagtaggtgctaccaatattcccatttgacagatgtgctaactggaaagaggtgaagtaactttcccaaagtcacagaacagtgagtggtgcaaacaggatttgaacaggggcaagctggattaagagcccatgcacttgaccactccatccactctttgaagctagtccttcaagaaccaccatgttgcagttatctcagcattttattttatttattttattgtatttttagatttcattttattttaagttctgggatacatgtgcagaacggacaggtttgtgacataggtaaacgtgtgccatggtggtttactgcacccatcaacccatcacctacgtattaagccccacatgcattaacaattcatcctgatgctctccctccgccggccccaaccctgacgggccccagtgtgtgttgttcctctccctgtgtccatgtgttctcattgttcagctcccacttatgagtgagaacatgcggtgtttggttttctgttcctgtgttagtttgctgtatctcagcatgttatatcttaaacggctcttatttgtgttgggagtggttgagtaaaaaacagggtcagcagttgctggtgaagtgggccttgtaagagctctgagagagctttcatgtacaaatggaaaatggaaacggttcagagaaatggacaaggttagaaaaatacgtggcatctgagaatcatgaggccagaaagaaaggtcattctttggagctcagtgggtggggttatgaggccaaaaggatgcagtaagttcctttaactttgagaaggcaagcaatagttgttgaatagttactgcttactctgaaacataatagatgcttagtaaatatctgttaaatcaatgtaagagtggattctgttcttgctctcagctgctaggcagctaatccttgctccaatgagttagctgatataatgtcagtcgataaaacattctaggaagttaagtgttaagtcgggaggggtgtggtgcaaacatttcatgtgttagagtaataatttttttcctggaccagccctgcacacatgtgaaactgtgtggtcacagtatgccctcactgactattcgaaatggggttgccagaagaaatgagaaacgccctgcctcagacttccccaaagtataacaaatgagaggtcatctctattcctaggaatctacaaagactcctcaggtttctctgtggaagccaccgtgaacctgtttattcatttctgcatttggaggaatgtggactagagcctcctaagttgagaaaagcaaatgtcaaattcgacattgagaagggaagaatatctttggttttgatttttaaatagcaatgagtcagcttaaccagatccttctgtacaaataattccacctaagcaattaaaggagaaaaatattggaagatcttgcattgggagtgtacaactaattttaagacacaaaggttagtatcccttgggatgtagtttcccattaaagattgctaataagttacaaatcctaccactactcccttctcaggtttcccacaattttacatttagaaagttaaaccatgctttctctttctctcttgtacattagtcttttagatgtgtagtacttaaaagaaatgcatgaaattaaaaatgtcctgggtttggctgtacttgtacctgggtacaattagagaattccagacaactgttttgagttatgctgcataccctaaaaatagagccaccatatttaaatagccttgaggagaaaggatggcagaggtccttaaatctggggccagccccagactaatccagactgagaagaatctgcaatcactaggcttacaagttcaagtcactccaaggctcacaagtgtgagttagcacttaggactgggatgactacaggctggtgtaggctaaaagaaaaggggcagaaagctgtaagcaggccccggagttaagttacactgctgagctgtaagcagtcccaggagttaagttcaacaaatctttgagaatcacctacagtgtgcacgacatatgtggtgatcggtcaaggagagagcagacctaagtggaatctagctggttgccattgtaagtccaagttagtatcaaacagcaggaacccaagtgaagagactaggtgaacatcagggttaggaacttggatagatgtgtgggtagaaaaagaagagtgaaataacaggtcctaagtgactgctgcaaaggtggagcttggcaagaagccaagtcaagactgaggcaggggcctcttgtatgtttcctgctgtagggcagaactggtcccttagtgtagtccacaggtgtcaacaagcaagcacacctggctaatgtggagatgtggaaaggatgggaaatgagacactcctggacagggagatcagcttgagtgatagctcacatgacatctcatttttgctaatcagtttgaatcctatagaggttgtatatttttaatttaaaattttatatccagcttcaaaaacaatagaacctaagttcattataaatagatgagaaaattcggtaaacaaatgaagaaaataaatttcaagtataatcctaccaccaagattttaacattttggtgtgcattttatacattgaaattctacttctttaatggacccctaaattccacatgtgcctccccattccatttagtttggaatagtttcctgaatatatttaaaaaggttttctgttcagtcaatgcagattccccacagtaaccctaatatgctggctttcatggcctcttagtaagtagatgttttataaggcattataccttgatgacttctttatagggtttctgtgaaattcacaacctgtcagaacagcatggcttccaacctgctcacagccctgctgggcaacatagtgagcactgtttctaaatggagtaaaactgattctaggaacaaaagagacagactcggggagcaagtgagaaaagggaggctaaaggagaaggtgaaacattgaagtcataagcagaaggtgggaaaagtgagtcaaggatagagtccaaaggtgagaaaagataataaagtcaggtaacatggttaccagaggctaggaagagtagtggggggttggagacttggggggaggtggggatgtttaatcagtagaaaaaaaaatagaagaatgaataaaacctgctatttgatagcacaacaaggtgactatagtcaataataacttaattgtacattttaaaataactaaaagagtgtaattggattgtttgtaactcaaaggataaatgcttgaggggatggataccctattgtccatgatgtgcttatttcacattgcatgcttgtatcaaaacatctcctgtaccccataaatatatacgactactatgtacccacgtaaattaaaaaatgtaaagtgaggtaaacagagtgactatgacaggaagaaatgaatgaaaaaaacaagttctagctgtttatctctctcttatcattcatccacctagataatagttttctctttacatttaaggagagcctggcataatgaaatgagcccattgctggaggccagaagacctgggttccactcccaggtctgccattaacctgctgaaagatcctaggcaagtctcttacctgctctggatctaaatctccccacttgtaaaatgatgggcttggagtacatgatatctaatggtctgttttgtcctgggtatctcatattgctaggtatatacagaatcaatttcacgttaaaatataattccaagtaccatttagaatttggttgtgtatcatgcacaccacatggatttaatgttaaagtgttatgtggagacaaacaattataattgttttaattacccagagtagctagtaatttctataagacttgggagcactgtcttaagaatgctattattacactgtcacttttcaacagtctttccaatttaggcatgataatttcaatgtcccaggagtggggacaagattgctattaggctgataatcttactggtaatctttttcttcacccctgccccccttagtgtgaaggttaacgctgagcagtgagagtctcttagactccatccagttacttcaccaaagaatgtgaatcagatgcaacctgtccaggtcattgtcaggcctgcataaggcctcaggcaattatatataatcacttccttgtagctttgaaaaggtgtctgacagaaggtatcatctatcaggtaccggactagctatctgattccagagttctcttcctagcttggtttggttggcatcaacatggctgtggatatagggggtggtggtcaggcagctgttcagcttgattctccaggaccccccaggatagtcacgtgggccggaaatctttctgggcagttaatcctaagaaacgttaagccttccatctttcacacatgcagcactttgaactgctttatgttttcagaaataaaataaaaaccagttgtaatttggtgcgaatttcacacgtgcacaagcatctaaaaggcttgttctctctgcttacccccaccaggaaaccttaagtacccagtcaaactgtgcttccctccagggtttattgctgagtcctgtgggctctagggaaagggccttggttccttcctacttattctttgttctttgatgtgtctaactgcaccttgctctccaccagatgctaaaaggttagactgcctgcagagaactccattttagaaggaaccgctgctacctggtaattagcctctcaccactcttagcagttttccttttaccaggagttaaaaccccaggaagggttacagtttggtcaatgaatttcttctgcctctgccctgaaggagctccctttcctcgttccctaggtgatttactgagtgcaaactttcaaattatgttcagcttatttcctagaaaacttgttgcagctgcctatattggtataggtgtaaaatatgagccttttaaaaaaatgtcagaacatttgcatttttaccgaaaagtaaaacagtctttaaaaagaatccctcctagggtttattcctcaagaagttctgagattcctggatgtagcctgcagaaaaaggcttaccttcagaggggtttaagctctctgtaaataaggtgcacacctattgatgtttataaacagagctcagtcgaggtgaaggagtgcagaccaagatttcaccagatggctaaaattaaatcagcataactgaaaacatgcttagcctagaattgcactaaatggtgtcaaaatgcagaactatctccatacttcctgttctaattaacacaagtccaatcctctcactggagtgttctgcttggttctggcttccaaaatgctattcggagttcaggatttgaagagtaaaagactgatggaaattagccagaaggaactagttcacagttgtccccacaaatatgctgaatgacaatgtgcttatactattatagatggaactggttctgggccagtgccagagtgggtgattggggtaagttacaaaagggataatacatggagaagctctgaggttcaccaaaagaccagaagaaaaataccagatggttggccagacacactggctcatgcctatagtcccagcactttgggaagctgaagcaggtggattgcttgaactcaggagttctagaccagcctgggcaacatggtgaaagctcatctctaccaaaaatacaaaaattagccagtcttataactcagtctcaaaataagtaaataaatagataaaaaatttaaaaacaaaattaaaaaattaaaaaaagaaaatgccaggtgctggacttaaatttttatatttatttttctttttatttgagacagaatcttgctttgttggccaggctggagtacagtgatgtgatcatatttcattgcagttgaactcctgggctcccacctcagcctcctgagtcactgggactacagggatgcaccaccatgtccagctaattgtttaatttttatagagacagggtctcagtatgttgcccaggctgctcttgaactcctggcctcaagcagttctcttgccttggccttccaaagctctaagatcacagacatgagccactgtgcgtggcccaggtgggtgactttaaaaggaactggtgaacaaaataggttgtcagaaggagatttcataagttaatgccagcagaaagcttttgatatgagaagccatgattttcttttcagacctgtgcaaaggctacggagtgttgaaggaggggttcaaatatgtgcacacattggtgaggaatgttctgagcatccccactctcagataggttggtgtggggagaattcagtaacaagggatggagagtaagtgaggcaagctgcttgggtagccccttgttgtgcatgtggtctgtgggccaattggtaaagaaacaaatgtcaaggatgagcaaagtgatgcataaaggtgaatgaaagacggtaaaatgaagcctaaactcagcgatgatggacgcaaacccttatcccagcagaaggcaaaaggggagcaagcctgtaagacctgcaaagagaataccaggaatctctaggacactctctctctcttaacctccccaagtccaactgcacctattacagagccatctctcctatctttacctctttgtattctcactaccactgtcttaatccaggctaccatcttctctcacctgaattatagcagccccaacctgactacctgtcacctgttttaccccctcctccacctatcccttaaaccatcattcctcaaagtgtagcccacagaccagcagcatcggtctcacctggtagcttgttagaaaagtatattctcaggcctcaccacatatctatagaatctgaacctgcattttaacaagatccccaggtgattcatatgcactttacagcttgggcagcagtgccctaactacttttaggctgctgtctctaagacacaactctgaccttgtcaagtccctgctgaatatcatccagctactcctaaccccaccctgtacctcaccttcaaggcacatggcttcacatgccacaacaactccccttggtatgacttctgcccacttttccagccccagggtctcattttctcctttagcaacaccaaactgcttgcagtttcattgttcaaaccaggttttctaatctcttctgcctctaacactcttcttctttccgctggctaactccaattcttgcttcacacctcagcttagatgtcccatctgttaggaatcctttctactacgccctcacccatctttatgggttaggtgatctcacattaccccctgcatacatccctccacaaaatcacttagctcaaactgctgtgattaaccatggatgtgcctgtcttctctgccagcctatgtgttccttggtggtaatgcctgtgtcttgttcatctcagtgtccctggagccgaggagagtatgtggcacagagcaggtgctcaataatctgtgttgaattgaagggacagtagaaaggatcacaaaagggtaatggcatacacaaaaaggaaaggaaagggcaggcacatgaaaattaagcccagagtttgggcagataaaaattacaaacaggaaaacaaaagagctcgaaaaatacaataaacaatagagtaaaaagcatactaaaggagagatgaggcgttgacttttaaagtgtttattaaggagaaggttaagactgatgaaacagttctctgtctctgtttttgtgtatggctgttatggctgagacttacctatgaaaatgtggaatcagagggttaaaatgaccaaaaggtaattcatttacttgccacctggagagatgatcagctgatactggtttatctgagagaaaaccaatagttatgtgtgtgattctaaatattgcagatcttgaatattcaaataaatattgcccttgtcaaaatagacccctcagatggtgcaaatgctaatagctaggtgtagcctgttctcacactgctatgaagaaatacccgaggctgggcaatttacatttgtttaaagagctttaatgattcacagttccgcatggctgggaaggcctcaggaaacttacaatcatggcggacgggcacctcttcacagggctacaggagagagaatgagtgcaagcaggggaaatgccaggcacttataaaaccatcagatcttgtgagactcgctcactatcatgagaacagtatgggggaaacctcgcccatgatccaattaccttcatctggtcccgcccttgacacatggggattattataattcaagatgagatttgggtggggacacagaaccaaaccataacaccaggtgaccacacaccaggatttgtccaagacaggcctggtttatgcctgttgtgataatatccttattacaagtgccccttgttatcctctaaagtgtccaggttaggttcataaattatatggtcacctagaagtagtcaacacttattgagttcttcctatgtgtcagacactgtgtaaagtactttacatgaatattctcgctagaagctccctgtgatcccttttgagatagacatacagttcacataacagtaaattaatcaaattcatccttttaaagtgtacaattcagtggtttttttgtatcttcattatgttgtgcaactatcccaaccatctaatcccagaatattttcatcacctccaaaagaaactccatgctcattattattcactcccacccagctgctggaaaccactaatttactttcagtctgtagggatttgcctattctggatagttcataggaattgaatcacataatatgtgactttttctttctggcttctgacaattctattttacaactgaggaaactgaggctcagagagattaagtagcctacccacgatcactcttctagtggtagaggagtcagaactaggcccaggtgtgtctggctccaaagcaaacattcttagccaccatgctgtgctgccacctcatatttattgcaagggcttagcacattcttggaactcctctttggccctctgtagctgggcacattctttccaaaatgcctcacaaatcttcattatttgagagggaatttagtgtttgggaagagccaaaagtcataaaaagcaaatatggtaacaaaagtggaccatcaagctgggtcattgctatagactgacttgtattctcccaaaatttatatgttgaagcgctaaccctcagtgtgactttatttagataggacttttaggatgtaattaaggttaaataatataaatatggggtccttatctgataagattgttagctttataagaagaggaagattctccctccctctctctctctctctctctctctctctccaccatgtagaaatatagtgaaaaggcagccatttacaaaccaagaagagagcctttaccacagtccaaccatactggcaccctcatcccaggtctccagcctctagaaatgtgagaaaataaatttctattgtttgagccacccactctatggtattttgttatggaagcctgaactggctaagacagtcatatttggggataaaaaatgaggcataaccataaagtcaggagaatgaatgattatcatctgtgactttgagaataatttcctgaaggggtcataagaaatattttgaatgccagagtcagcattggaaacaggggaagcctctatctataagacattttgtatgacactatgcttttaacatttagaatatctattgtatttctctggaaaatataacaagtataagcaaaaagtaaaaataacccattatgctactattaatgatatgctatatttccttccaatctatcttttcctgaaaccttaattgtatagtctgtatttttttaaagcacacaattaatatgtaagatacattaaaatttctctctttttaaaaatcttttaattttaggtttgggtgtacatgtgaaggtttgttacataggtaaatttgtgtcaagggattttcttgtacagattatttcatcacccagctattaagcccagtacccaatagtgatcttttctgctcccctccctcctgccacactccaccctcaagtagacctcagtgtctgttgtttccttctttgtgttcataatttctcatcatttagctcccacttataactgagaacttgcattatttgattttttgttcccgctttagctcgctaaggataatggcctccggctccatccatgttcctccagaagacatgatcctgttcttttttatggctgcacagtatttcatggtctatatgtaccacattttctttatccaatctgtcattgatgggcatttaggttgattccatgtctttgctattgtgaataatcctgcagtgaacatttgtgtgcatatgtctttatggtagaataatttatattcctctgagtatatacaataatgggattgctgggtccaatggtagctctgcttttagcttgttgaggaattgccatactgctttccacaatggttgaactaatttacactcccaccaacagtgtataagtgtttccttttctccacaaccttgccagcatctattattttttgactttttaatgatagtcattatttttaataccatttgaattgcgtgaaatggtatcttattgtggttttgatttgcatttctctaatgatcagtgatactgagttttttaatatgcttgttggctgcatgtatgtcttcttttgaaaaatgtctgttcatattctttgcctactttttaatggggttgtttgtttttctcttgtaaatttgtgtaagtttcttatagattctggatactagacttttgtcagatgcatagcttgcaaatattatctcccattctgtaggttgtatatttactctgttgatagtttcttctgttgtgcagaagctcttaagtttaattagatctcacttgtcaatttttgcttttgttgcgattgtttttggtgtctttgtcatgaaatctttgcccattcctatgtccaggatggtgttatctaggttgtcttccagggtttttatagttctgggttttacatttaagtctttaatccatcttgagttaattcttgtatattatgtaaggaaggggtccagcttcaatcttctgcatatagctagccagttattcaggcaccatttattgaatatggagtcttttccccattgctagtttttgtcagctttgtcgacgatttgatggctgtagttgtgcagccttatttctggactctctattctgctccattggcctatgtgcctgcttttgtaccagtaccctgctgttttggttactgtagccctgtagtatagtttgaagtcaggtaacgtgatgcctccagctttgttctttttgcttaggatttccttggctatttgggctctttttttgttcaacgtgaatttaaaaaaattttttttctagttctgtgaagaatgtcattggtagtttgatgggaattgcattgaatctgtaaattgctttgggtagtatggccattttaatgatactgagaatgtcttatttcaaatgttgttgaaggtggttgttgatcagttaattgacaaaatttgctaaagcaaacactaataacaaatcatatacatatatatacagacatctcaaattttttattttaacataaaatgtatacattttattcatatcctaactgtttgatatagggtcaagaccttttctttagtatggacttctgattgtattcccttttgtctttcttccataaaccacatccataatctgtcatcgatgatttccagtcttggtttatttaatgtggaacaagaatacaatgatttcaaagcagtgagtacagaatctttccagattttgatgtctttcctccgtcaatcttttattgctgtcatatccaaaactaatttgacagcacatttttggggactcccccttattgagtctttacaaaaatatcaatttaagtttcatagaaacaactcttgccattagtgctcataataatttttgatatacataccatttaattaaatggtgtaattataataataagtagagcttgtcaaaaatattttcaagaacataatcattagtaagcatgggactcaattggtcactgtcaaagtgtacaattgtatttgagtcacctactagccatgagttttcatcacaatgtgggcatctgccaattttttgtttgtttgtttgttttttgtttttttggttttttgagacggagtcttgctctgtcgcccaggctggagtgcagtggcacgatttcagctcactgcaagctccgcctcccgggttcacaccattctcctgcctcagcctcccgagtagctgggactacaggcacccgccaccacgcacagctaattttttgtattttttagtagagatggggtttcactgtgttagccaggatggtctcgatctcctgacctcgtgatcccaccacctcggcctcccaaagtgctaggattacaggcataagccacagcgcccagcccgcatctgccaatgttttaaagagggaatagaatgcattatatgcacattattaagtggaagttggttaagaaagtttctaccatccttgcttattaaaaaaaaaattcagacacgtacagagtaaaaagttaaagtcccccttattttatctcctctccaggaatattgttgttaccaatttggtgtatattcttccagatttattactatgcatatatctatacatgtgcattgctgaagtgcatatgcatatgtgcatgtgcatatgatgtgccaggcactgtactaagaccttgatgtgaattattttatttaaccctcacaacaaccctatgagataatatcactattatctttattttacagattagtaaactgaggctcagaaaagttcagtaattgcccaaggtcacataatgactagtttgtctctctcttaagaggactattatactaatgtacatgaatcaagttaaatgtctgggtccatttatccacttactcagtaaacatttattgaatgtccactttgccaggcactgtacttaattccaagaattcaaacacgtggtttttatcttcagatatctagaagaggtagatcaatctgtgagctaaatgatttgccccaattcgtccagctagtaagtgaagagagcaagattacaatcccgatttattttaacaaattggtatataacaattgttggtgcacagaaaatttggtagatttgtttttagagctagccactttgaatattattgtttccatgagaagatgagtttgaagcccccaggaatcagtgttcaattgttatgacccaataaattaaagattataaatccaagttatgaatgatttgtttaaattatagagatagatagatagatagatagatagatagatagatagatagatagacatttaaaggcagatatcaggatgagacaggattcaggattggagttccaattccttcagtgggaggactgacgggtggtaaagaatttagatctgctaaggagcttgattaggatattgaaaagtaccagcttaaaaaagaccaagcaattgtacagagaatcagaagtccagagaaaacagaaaagagaaagagaaaacaggaagcttgtatataaggcagtattacaagaaagagaaacataacaccaaaattgagaaattcgatcataatggtagaaaaaattaaaggctgcatgttgagacagaaccaagaccttacctattacataacacattccacaaagctggccaatttcaacgtacactatggaggactgaaggaaaatgcctctcgcggagatggggtggaaagcttgagccacatgagtgtctgacctccaaaagcataaatgccaaaggcttttagagccagttggcaacacttacagggatggaagaatcagggaattattcttataaacatagtatgggatcttacggaaggaagcaaaacgaaggccttaattagaaaccttaaaagaatggctacatatgctttgtaattgcagaaacatgtaaatatacaaacacatggaacatggcagtgttgatagggaggattaagtgccctgatggaaaataagaataaaatatgaaaaggagaaaggaaaatcttgagcttcttaaattgcttgcaaaaaaaaactggagtgtatgatggaatttggtcctcatgactgaagtgtttctttggtgttggaaaaagtattgctgtcatctctctctctttagaaattctttttttttttcataataaaaatcccatggcagctccttgtctatgaaggattttaaaaataggagcaatttcatgtgtctgcaatggtctgtgtcagcacttgccctaggcaaggttgccacacaggcaaaaatgtacccctctcccctataaacaggccctccctggcaaccccattcccttggtgccaccccccccaggggaactgacccccttttcttggactacagctccattgtgatctcccacatcaaatcaaaccccctttcccttggtagagcagctctgtctccaggtgcaagggatgaaataagtttcaccctttgcagcctattttcatttaaaaatcggactggggttaacccaaatgaatcttgagtcggtggagctctgggcagtaaaaccaagtagagagaagtccatggggagaggggtgtatttttggacggtgggggaagcgggtgaggtaggccgccttcctgaaaactattaaatcccagatgtgggctctgttcagtgtggtgctgccttgagggaggggggaattggtggtggatggactctctgacctctcaaggttgctgttaattctatgggtcggtgatttccaactacatttccccgcgcctggcttcctttgcagcactgtaggcaccgcgtgactcgcctttaactaggggttttcagcagccagtctttgtgcctatcagccagggctcaattttcccatcacggtcctccctgcaacagcaatccctgggttcagcaatagtggaggcaggctgaaaatcagtcccagccatactcagctcaaagaaatttttcacagagagctcttcaaagctcctgttctcagagaagcataagaaagggactgttttgtgctcacagtgtgtgtgggctttatgaagaaaaaaatttgtggccttatgtgaacagagtatgctgtatgcagatttggtgggcaaagctacaaaatgaaatctactcaaggggctcatataatcatatggtcaatttcatgttggatcaacaaacattcaggagcccagtactatgtgccaggctctgaattagaactggtgagtaacaagaaaaataaagcaaagtccctgctatggaggaattcagtctaatggggaagatagacatccagggcaagaagtgctatgcttgaggtaagtgagggtgtttggaggcataggggagcttgcccttggctcagcctgcggctgatagggattgaagaaaccttctctggggagatgacatctgagctgagtaggagtaagccaaaccaaagaaatgtggaaagagcgataggtggagaaggatgacatgagcagaggcatgcaggcacgcaatgactagacaggtatggggaactaagagcaggctgccgttattagagaggaaagtatcaggaggaggtgggcaagaggctggaggcgcaggcatggccacaggagggagagagaactgggtctcctgtgctgaggagtacaggctttatcctgagggggtgccactgaaggatttcaagcaggggagtaatagggttggatttacatcttgactaaactatctgtcaatttggaagaaatcattcaaattgcccatgggatgaactgattcaagaattccattgaaagggtaaatttgcagatgtagccatagttaagtgcaagtatttctttttccaaggtggtttgttataaggctttcttagggatgtcgctaaaacaacacagagacagataagtggatctatctgtaaaggtcaacatctttgaaaaggatgcaggtcctctaaacagtgcttaaaggaaacagggcttgcagagagtcttgtggcttctaccctttattccgtgctgcagtatcaggttaggaatgcaaattgtgctatcatctttttgttttgtttagcaaaagtcatccgggaaggcattgtttaacctgagttgcagccatctaaatcttgctgaaaaggaatattttggattagaattctgcagccattctggaaataatgtaagttggtttcattatagggttctttgtgtctagcattgcttctaaatgcagtttgcagctaggtatgtagggttcaattccctgattgaaaaatgaaaaactatgtgcacccttgcaacatgattagatttaataactagtttttgtcctccctctttgtttattaacagtcaccttggccaggtgcggtggctcatgcctgtaatcccaacactttgggaagccaaggcaggtggatcacctgaggtcaggagttcaagaccagcctggccaacatagtgaaacctcatctttactaaaaatacaaaaattagctgggtgtggtggtgtgtgcctgtaatcccagctacttgggaggctgaggcaggagaattgcttgaacctgggaggcagaggttgctgtgagccagcatcgcaccaccgcatcccagcctgagcaacagagtgagactctgtttcaaaacaacaagtcacctcaatttgccaaacacaaactcttttaccccacattcctgttttgtcactctgtgagcagctatgcatgctttatcaattttgcctttccagagcctggacctcaacctgcagaattaagacttttaacctcaccagtgaatattcagaggaatctcctttctcctttctcagaccctaacgttcagatattcttctgttgtgtcctgccttggcatatctgtgatctggcatcttcccagaaaggctcattatgtctattagactggcatttggggactggagggttcaaatgtggagccaaatgccttcattagtctttgtagcaactaatgagccatgtatgtgacacctctgtcatcctactaaggcagtggagcagtgattcaaatgtcaacaagaaagagtttatagatcaacaatgttcactgtcatcgggaaaatataagggggcagattaaacgtagtatgccacctatttgacattgctgtttgtttctacctttagaagtctaaatagtcctggtactcatttatttcatgttaatctttatctattaccgaaaaaaaaaaagctctgctcaatgccatgctctaccaattttttccttaatgttattacaggtttggctggagcttttgaagcccataacaaagcaggtaaaaagtaagtatggaaaatcatttaaggaagagagttcacagttagagcttgagaaaggtttcaacaacctcacacaatttctcattttaatataaggggagaaaagggctttgagatattatttcaacccttcatacatccagtaaattcagcaatttagaaaattgttttaattttgcctgagatgaaagaaatcatgctgctggatctttgagtaaatctgaagaactctggtaattacagtactctggattggtttgaggaatatatctcattttctggcactgcaaatcttcgagcatccttgatgtcaatctgcaatgccattcactgtctgcctgaagattctttagttatatcctgtcacaagcattattcactcgctttagttcatatttaagtgcctaatatgtatgaaatattttctccctatattttacaatctagtgtgatggttctcaaatttcagtgtgcattaggatcgcctgagtttcttgttaaatgccgattcctgggccttattcctgagttgccaataacctgcatgtttacaaaattccacagatgtttctgaggcaggcggagttgtatcaggactttgcactgttttaatgtctcttttactggttcctcttcctctacctgctctttacatgttagtgcttcccaaagttctgtctgttcccactgcataaggatcacctgtcacattattccaacagcttccaaattgattcccctcatccatcatctacattactcccaaagaaatctattgaaaacaaaattccacagatgtttctgaggcaggcggatttctatcaggactttgcactgttcctcttcctctacctgctctttacatgttagtgcttcccaaagttctgtctgttcccactgcataaggatcacctgtcacattattccaacagcttccaaattgattcccctcatccatcatctacattactcccaaagaaatctactgaaaacaccaacctgatcacatcactcttcttcttaaaatgctttcctggctccctactacctacccttcgaggaataaagtcccaattccttaggatggtacacaaagcattgaactctggctaccttcctagccttgtccttgctactagctacctcgtattcctacctctgctgactttgacaaaactaatctcagatggaggcttagcagataaaatacagaatgccctattaaattgtaattttagataaacaaagaataattttcttatataagcacatctcatgcaattgttgtttatctgaaattcaaattgaactgggaatcctgtgcttcttattcactaaatctggccactctactcaggtctcaagtcctctggtaggacatccttgacctcctccaaactctttcctcccttctgtgcttccccagtactcagtgcttatagcattttagagtgttataactgtctagatgtctgtctcttctactagacagtgagctcttagttgtctttttactcccaatacctgctttgcagataatgggcaccaacaaatatttactgaatcaatggtgttaatgctgcatgtgtgcatttatgttttgtgtaaaagttaattttcaaatgcaagcaggtgtgaagataagtatatgtgttttcttaatgtataagatagaggtatcagtccatcatgctttgaattctctttatgagatacttaggcttggtaatgtacacctgcctcagctgaagttgagcccttctctcagtcaggaatgcagaatcccaactagcaagtgctgtatttttctgaatgggatacttaggagaggacacagtaggcctcaaaggggcacatttatacaaataaactcgaaggcagagagggtagaaagaggggtgggagaactttcccaatcgctatatacatagagacacaatccagaaattgtgacactttatacatgtgataaatggaaacacagaagtctgtaggagggagtgatggggaggggacggaagaggagagcggtgtgtgtgtgggtgtgtgtgtgtgtgtgtgtgtgtgtacctataactgttgtgatggacatttaaataaaacttatggagatattgtgttttaagatcctaaggagattgttttcaaatttatggtgaaatttttcccagtggaccctggacatctgcgggaagaacttacaaggtatagtgattacctgtgtgtctctgcatgatgttacttaagaatcattattctccatttattgggggcaagtgcttctggccattctcacaaaacttggctttaagtcactgtctgggagatggtgaggatctggagagaggatgggcctagctggttccccaggtgttcatcatccaaagggtggagactacaggaagaaagaggtgtgttctagaagttcaagcctgggtatccacttgggggttatgccattaactactacaacaatgaatgtgctctccttcatgaatctgtgtttcagtcagagagggcagcttaacagcacgggtataataccagccgatttccatggaaattgaaaatgtgggggttgtgaatgtatctcacagaagacaaaataatctgtaatgatgataaatacttatgaaaaaatgtccttcagaattacaaagtaaacctatttctgcaaaaatatgttgtcaacaaaacattcctcaaaaccttactctactttctagacttacacttttttttttttttttttttgagacagggtcttgctctgcctcaggttggataggctgaagtgcagtggcaacctccctggctcaagcaaccctcccacctcagtccttgtgccctgcttcccgccaaggactacaggaacttgccgccacgcccggctaatttttaaggttttttttttttttttagagatggggctttgctatgttgcccagactggtcttgagctcctgagctcaaatgattctccgccttggcctcccaaagtgctgggattacaggcatgagccaccacacctggcttagatttagactcctatacgtgaaagaggtctgagagataatctaatcgagccctcttagtttacagaggaagagataggtcatgggagctaaaatgactgtccaagatcacagaaggttgccagttattctccctgatgtcttccccccaaaagagttcatggccagttcaatctttgccccttttataaagacttttctgagtggcctttgcaaaagtcgctttttacaagcctctctttctgtctttctctctcctaattctctctccacatttgtgagctacaggccactttcccaaataacttgataccttggtatatatatgtatttgcgtttgctaacccatttcagttgagttttaaattgtgaccaattttgatggagataaactccccccacctccaaaaaaaaaagaatgggaaaatcaatgtgatgataaatgattcatcagctgttcagagcaaggatttggtatttgtagcaggcagctgccttcttaacagcaaggaacgtgtcaaatgacaagaagttccctttctttcatgctaggagcaaaacgaaattcacctttcctttagcaactaaagctgattattctcattgacaactatatttgaaaacaggcaatgacaaaggttaggcttcatttatttgtttcccattggtccatttaaataatacttaactttagttgagtctacaaggatgccttgtctaggctaatacatgggtttctaagagtggtgtgcaaatgtaatttttctaattgaatcgtttctaatgtataaggagagctcataatttgaaagattataatgatgaatgcttttgtaaactgaataatcacctgctaatttacttgctttttcaatctagattttcacatatcacttgcgattaattttgattcaccacattgccttcaaggcttaattggttttaaaaaaagtacacatagacctttatttagaaaatcacatttttatagggaaatgctcatagtactcagtgttttaatttataaaacaaaatattggggccagacacagtagctcacacctgtaatcctagcactttgagaggccaaggtggggcaatcaactgaggtcaggagttgaagaccagcctggccaacatggtgaaacctcgtatctactaaaaatacaaaaattagctgggcatggtggtgcatgcctgtagtcccagctgctaggaaggctgaggcaggaggatcgcttgaaccccagaggcagaggttgcagtgagctgagactgcaccactgcactctagcctgggtaacagagtgagactctatctcaataaataaataaataaataaataaataaataaataaataaataaataaataaaatattggaaccaatcttggaccatggaagaaggtaattagtggtaggtagtcttcattatgcacatttctttacaaaatttgattctcctttgaaaatgactttttcataagtgtgggataaatgttatctgtttagcagagccctagataccaagctgcatttcataggtccctgatgagcatttggtgggaaaaggggcagtttggtttagttcttttcagcaaacattaattacactaactgtgtaaaatgatgtgttgggcactggtgatacagagaagatggtccaggccaagggaataacaggcagaagcagggccccaagttcttcatttctaaaacacagtcttttggataggaggcagcctgaattcaggggcagacctaagttctagccacagattcactatccttgggtgatatgaccttgtcaaaatcacctagcccctctctttctataactgtaaactggagtgatcatttcttgctccaccaacctcctaagttgttatggtagtgagtacttgatagtgttttgtaaacagtatgctactggcctcctgagtgcatttattcttgcttgatctcctattctttctagctgggaatgtggctttgctacgtggcagaaaccaccagaggatgattggccaactttctcaatttggcaggaggatttggccagggtgattcctaatggctgtgaggcctgccaaagtgttcaatcagctgagttgtggtccgggtctggtttggggctgaagcaaagcctatgcattactcaccacccccaaaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatgtaagtagcaaatgtctgtctgctttgggacctatcagccaggtagagaaccaagcacaggagctgagctccccacacatgcccatcactgtgttagggtttacaggggagagaaagcctggataagatagagagaaacagcatggcctgagcctgagtttccttgtctttaaaatagtgacaagaatacctttggttctgtggattaaatgtaaatgctgattttcttctaccccagtccagccttcccctcctaccgcctctgggaaagctgtccaggaactggtttgggctaatttgggcatgggctttgccagacaggtccccactccctctgcttaccccaggataattctctgatacatgctctctgtagcacattgtcacgtttgttgtgatttctctgttgctctttatcatgatttcagagaacaaagcacagagtacagcaggtggagagaggttaaaagggaaaaaagccccaggcatctattagcgttccccatatcctaacaaccaacaagtagctggactaggctgcataacgaaggtaggtagaaggtggtctggggaacagcaggggccttccagggagggggtgatgcctggcaggccaggctgctgctacagccccaagggcagggtataggcagctggagatagtatctcttctaaagccagctggacattttctcccttctagagaggcctccaaagaataggctgtttcttaccagtcctgcaggatcataacttcattttttgtatcttaagttcatttttgacctctgtaccttacctttctgatagtccagaaatgacagatttctaatttcaccgggagccccagaatgcagtgcttagatagggacagtgtctgaataagtgtttaccaagtgactcctggcagggacaatcaatgagagccctaggatctcagaaaggcagagggcagtaagagaaatggtaatcatggaaggctgttggagaaggtggcttttgtgctgggccttaaagggacacataggaattggataagtacttgtcagtaaaggaaacagcatgaaaacaaaaatggtggttagacaagaagtgacgtatatagaggatgaaaaatgacccagtatagcccaaacatagggcctgtttagaagaggtgatggaaaatgcaccattttgaagggtcttgaatgccgaggacactaaccgtcatgtccagtattgtactttggcactggggtgggagcatagggtagagcagatagaggaaacagtgctagaagacatccttctccactagctgcctgttgaggcagcagtcagaggattggggctcccaggcagtctctgacgggggagctcaatttcattcttaacagttctgccttatggatttgagcattccctagtggccgtttcaggcatagcacagagcacttgagcttttctagaggatattgtctgtcagtagaaactctttccatggaaaaaagctaaagttccaactaggtagttcttcgcaattgattgcagtgagactatttcactaaactctaacgtagtatgcagaacacaactagattgctctagttgtgcaatttatttgtctaattttccattcatctaatatttgttggatacctgctatattttaagcgttcaagaacctccacatttatttgtctaattttccattcatctaatatttgttggatacctgctatattttaagcgttcaagaacctccacattccaaccttctcgtctcctttgtttacacttacacacctctctattctagccagacactccctcccaaacacaagctgaacatttcaaatgaagtgtccctcttttatgaactccctcagtaactcttcttggtcgttaattcaagaaaattgtatcatgtacctaccacatgccagatactattataggcactgggaacacagcaataaacagacaaaaatccttgcccttgtggagctcacattttggcagcgggggaaaatcagacaatgaccaaaataagtaaataaattatataatgcatggtagcaggtgataagagcaatggagaaaaatgaagcgtaggagggagatggaagaattctgggggcagatactgaatatttatatttttaaattttattcttttcttcttttatggacaagagttaacatcggcataaatattattttttgagatggggtctcacgctatcagccaggctggagtgcagtggggcgatctcagctcactgcaacctccacctcccaggttcaagtgattctcctgcctcaacctcctgagtagctgggattacaggcacatgccaccacacccggcttttttttttttttttttgtatttttagttagagacagggtttcaccatgttggccaggctggtcttgaactcctggcctcaagtgatcctcccgctttggcttcccaaagtgctgggattacacgcgtaagccacagtgcccagccagcataaatatttaaataaggtggacagggtaggcttactgggaagatgacagctaaacaaagacttgaaggaggtgggagggtaagctatgcaacaaaatcatgtgaaagagaatcctggcaaagagagcatgcagtgcaaagggcctgaggtgagagcatgcctggggtgttcaagaaacatcagaaaggcttttatggctggctggagctcagtaagagaggaagagaataaatatgaaggtcttaaaagcatattaaagggccaggtgtgttggttcatgcctgtaatcccagcactttgggagactgaggtgggaggatcgcttgaggccaggagtgcatatccgactggccatctcttttttaaaaaagcatatgaaagacctatagcataactctaaatgagcagataagccatcgaagcagtttaagcagaggagtgaaataatctgaattaggttttgacggggtccttttggctgctgtggtgaaaacagacctcaagaggaaatggtggaagtggggagactagataaaaggatattacaggagagagagaccatggtagtttggaccagcgtggtaacagtgaaggtgcttataacatttgtcaccttctgttactggagctatttactcattcgtatgtcatagttgtattcttaggttgctatagtcttgtatggagagaaaaaaaagcacagtcttatgtgcttttgtttttcttagggtcaacgtgggatttgtggttaataaactggaaaattggggtgtgtgtgtttgtgcatgtgatttatttaaaaaaacagctctattgaggtataatttacacatcataaaattcacccattttaaatgcacaactcaatgatttttagcaaatttacagagttgtgcaagcattaccgcaatccagttttaaaacatttccatcacaccaaaagacatctctcatccctacttgcagtcacgccctgttcccacgctcagccccaagcaaccactaatttgctttctgtttctgtagatttgcctttcctgaacatttcatgtaaatgaaatgataaaatatggggtattttgcatctgacttttttcactcaaaataatgatttttaaattaaagcatgctctaacatgagctgcaacagtttgttcctttcttttgctgagcagtattccatttatggatttaccacttttttttttgagatgctcactgcagcctccacctcccgggttcaagcaattctcctgcctcagcctcctgagtagctgggattacaggcaggcaccaccacgcccggctaatttttgtatttttagtagagacagggtttcaccatgttggtcaggctggtctcgaactcctgacctcatgatccacccactttggcctcccaaagtgcttgggattacaggagtgagccactgcgcccagccacattttgtttatctattcacctggtcgtggacatttggattttcttccagtttagctattatgaataatgctataagcattggcacacaagtgttcttgtggatacaagtcttcatttcttttgggtacattccaaggagtgtaattgctaggtcttatgatatatttatattgaacattttcagaaactgccaattcaaattgttacaataacattagaaatgtacaaggtttttgacttcttcataccttcactaacacttggtattgtatatctttttgattatgaccattctaatgggtataaagtatctcactgcaattttaattagcattttcctaatgactaacgatgttgagcacagtttcatgtgcttattccaatgttttctttggtaaaatgcctagtcaaatcttttgcccatttttaaatgagtttttatattattattgagttttaagagggttttataaattctgattaaaagtctttataagatatacaatttgcaattttctcttctaatctgtggcttgtcttttcattttgtaaggatatcttttgaagtacaacagttttaaaatttgatggaatttcactttctgtgtagttttagtggatcattctttcggtgttgtatctaagaactctttgcctaacttaaggtcaaaaagattttctcctagaacttttataaatttacctcttatagttagatctatgatccattttgagctatttttttgtacgcttgcatggagtatagtgtgaggtaggggtccgacttcatatttttgtgtgtggatgtccatttgtcctagcaacatttgttgaaaagaatattatttttcttcattgaattgtcttggcacatttgtcaaaaaccaattgaccataaatgtaaggagttacttctgtactctcacttatgttccattgatctatatttctattcttatgccattaccacactgtcttaattactgtagctttgaggtaagctttgaaataaggaagtgtacacattgcccaactttgttctttttcaaaatagtttggttattctgagatctgtgcatttccatgtaaattttaaggtcatttgtcaatttctatttttaaaagcctactgggattttgatggggattgcattgaatttatagattattttttgaaaaaattgccaccataacaatattgaatcttcttgtctgtgaacatgaactatctcttcatttatatagatcttttaaaaatttcccttggcagcattttgtacttttcagtgtgtaagccttacacttcttttattaaattcattcctctgtattttattcttttttgatgctattgtaaatggaactttttaaaatatcatttttagattattcattgctagtatatataaatacaattgctttttatatattgatcttctatcatgctaccttgctgaactcatttattagttctagtagtttttcataggttccttgggattttttttctttcctttttttcctttttttttttttgagacagggcctcactcattcacccaacctggagtgcagtggcacggccatggctcactgtagccttgaattcctgggctcaagcaatgctcccacctcagcctccaaagtagctgggacctgggaccacaggcatgtgccaccacacccagctaatttttacattttttggtagagatggggtcttgccatgttgcccaagctggtctcgaactcctgggctcaagcaatcctcctgccttggcctccctgagtgctaggattacaggcgtgagccaccacgctcaaccttgggattttctacatgcaggatcatgttgagtgcaagtaaagacagttctaccaccttcttttcagtgcaaattctttatgtttcttcttcttgcctgactgcactgactagaaccatcagtacaatgttgaatagatgtggcaggcacttgatatctttacctgatttctgatcttaagtgaaagcatttagtttctcaccatttggtatattccttgtttgttaagtgttttgttttgttttgttgattgtgagtgggtattagactttgtgcaatgctttttctccatctcttgagaagataatgtgcgggttattttttttttgtcctttattctattatcatagtgtattatagtcattggttttcatatgtcaaactgaccttgcaatcctgagataaattcaactcattgtgtataatccttttcatatgctgctgaattcaggttactagtgttttgttcagaatttttgcctctgtattcatgaggaatgttgacctgtagtcttcatttcttatgatgtttttgtcccgttttggtatcagggtaatattgacctcatagaatatgttgctaagtatctactcctctattttctgggagagtttgtgaagaattggtatttatttcttctttgaatatttgatagaattagtcagtgaaaccatcagagccttattgggtttcaatgtgatttgtacatttatcagtattggcaaaaaaaattaatcaatgagccatttctttggtcttttaaaaaatgtttattatatggagatttttattatattgtgatttttgaaatacagatatacacccacctgtctaaaacacaaatggaaaaccaagaaagaagagaaaaaaaacagccctccagcactcaaaataggtatcctattgtccatgtatcttatccaatagaagagcaccataggattccatggagagtctatttactcttacagtatatagaatgctaacaggtttggatatttgctttctcattttatgttagactagaagtctcactttagaaccaagtattctaaagtttgacttcaggggaagtcagtgaccaggaaatgattcatataaatctgacagagaggaaaaaggcatacaaattataaagaagaaaaaagaatccaaaaatcaaaacaatctgaggcaattaaggttaagggcacatagtcctaaatgcctttgtagacatagtgctgtaatagatgtttcataaaaataaactggaggcatctagaaaagagcaaattatgatcatagataaactgctagctatttggaaaagccagaatgattttcaggatgattcatctattggggatttcagatagctggggatttactagactcccaatgtacagagtgatgaattggcttgcaatgtcgttggcatttatattcctctttcttgataatatatgatcaggatggagtggggttggatggctgtactagtttgctagggctgccataacaaaataccagagactgaatggcttaaatgccagaaatgtatgttccacaattctggaggcttcgtgtccaagataagctgtcagcagttgtttttttttttttcctgaggcctttctccttggctagcagatggctgccttcttgttgtgttatcacttggtctttttttctgtgtactcacatccctggtgtctctctgtgtgtccaaatttcttcttcttataaggataccagtcagattggtttaaggcttgccttgatggagtcatttcacctcaatcacctcctaaaagctctatctccaaatatagtcacattctctgctactggaattaggactccaacatatgaacttggcagagggtggggacatagttccacctataccagtggctgattgaaagtaagagagatcatatatacaatatggtagaagaaaaatctaacaaaatgttcaactgtgatcttggagcccctaagatctatatttggtctgtgactttctatactaaggctgaaatgcttccaaattgaaaaagagccaattgccccccccaaacacacacacccctatagaaacataaatatacataaagcgtggggttggaggctttggactgcattggctacaaagaaggggctgtttgatggaggacaagggtatgctggatgctccattgctaagttcctcaaaggtaatgtgaaaaatgtctttttcctgtcatgcagcagaacttggagactttcatgaagaaacagataggaagcatctggcacaaactcggtacttaccaaaccaagactgtttagagggcaagatcatgcactttcatcagaagcacatgtaagtactttcagctggcacctgcttcccccagtagagaacactaaaattggggacagactcttaagagcaagcccttaaacctgagaagtttcaggctccatgaaacgctgagatcctcatggagctctcagggtggaaatgtcattcttgaggcatttattaggctcataaattctttcccctttcagtggcaggagcccagctgaatctgacattctgctactggacatagcaaggaagctggatatgtatggcatcaggcctcaccccgccagtgatggtgaagggatgcagattcacctggctgttgctcacatgggagtactggtgttacgggtaaaatctctttcctttcaagcccttcagctttagtgaggggtggttatcttggctcaaacttgggtgtcctttcccaaggtgatctcacccctcagtattatcaccagccagaaagggaaatggtcaatcatatttacttgtagttgcatgaaaagtatacatgacaaactaataaacatagttaactgcagggaatggatagatggggacagaaataggggtgacagtggtgggagtgagacttctttctatatatatctttttgtatacctctgattttcagaccacgcgaatagattacctgttgaacaaacaacaaataagcaaaaaagcaaagctggttggaccgaccaggaaagccaagggagtttagaggagttggaaatgggtgtaggctgcagtaattaaacagaatagcctagagaagggtctgtcagagctggcaagaaggcttgactatgtggaaggcattgtgggcaaggaaaatgaggagactgcaggagagaggtatagagttagatgaaagggtgttttggaattagtgggaacaaaggttatatattcaatatagatgaggcagcaagatatggccatgatgtgatgtgggcagtgaggagctattgaaggtgtttgagctattggggtgtcaggagaaagaggacattgtttttagcagatgaatcgggaaacatgggaaaggggcgagattagaaaagctattgtagtaatcctttcctcttgtgatctccctgtgctggccagaaaacttccctaggcataccccttcttgcttgcattccagagcatccttgtatcccacctgaaatgccttctttgaccacagctcctacccagtgcagcaggatcaatctgtgcaagagatgggtcaagggcggtccctctcattaagtgcattttctatcaggtttgcactgtcttacaagccaactcttgttaatacattctgaaatctgccacatttttcattgtagggaaatacaaagatcaatacttttaactgggctaaaatccgcaagttgagttttaagagaaagcattttctcatcaaacttcatgccaatatcttggtaagtagctttctaataaattcgtttactttctgttcactgggaatttttttggttgtttctgcaaatcgtttgaatgtaaattgtaaaagccggctggccctgagtgatggtgtgtcttttcttttgcctttgaagaaatcaaccagagttttaatcattttttactaaaggcaaaacactaagaaatctgattggcagtttagagttaacaaagtaataggaaaatggggcagctcggctgaaaggcaagtctccctggaaactgctttttagggatttgataagtcaaatgggagtgaccagatctaggactaagaatacattcatatgatgttatctgttccattttataaagtatcttcaattactttccttaagcaaaaattattgaacacctagtatatgccaaaaacaagcaggatgtgggagtcaggtatacacgtaagcaaaataaacagtttttgggcaaggttgcatagtaaagggtgagacaaaggtgctagaaatgatcttctttttttattctagagatagggtcacactgttgcccacactgaagtggagtggtgacatgtagctcagagcagcctcaacgtcctgggctcaagtgatcctaccgcctcagccttttgagtagctaggactacaggcatgtgccaccacacttcgctaatttttaaaacatattttgtagagacaaggtctcactatgttgcccaggctggtctcaaactcctggcctcaaatgatcctcttactctggcctcccaaagtgctgacgttaccaggcatgagccacttagtctagaaaggaattttcttatgaccataaagaaaataaaaagtgtgtatcaactaatttttgacctactgaagatccagcagtttggattttattctctgcatcttgaccttatagaaaagtgttcattgagcagttcaagaaactggacttagtgtgaagctcatggagagccccagaggctacatgcaggaacctggaaaggaatgagagaagtggggtcagtgcagtgggttgatggggctgctgaaaacagggctgcaaacatgccatgtgaggggtacatatagtgtcaggagatggggaaaactcgaactttaggtctggaaagccaagattagaatatgctagatgagcaatatagagcattgtacaagacaacctatagaggaaaaagtgtttctaactgttacactaaaaagactcatggactgagtgtagtggcttgcgttcataatcccagtgctttaagaggttgaggtggaaggatcacttgagttcaggagtttgagaccaacctgggcaacatagcaagatcccatctcaacaaaaaaaactacaaagaaattaagcgggtatggtggcacatgcctgtagttctagctattcaggaggctgagtcaggaagactgcttgagcccaggagtttgaggttatagtgagtgatgatcatgccactgcacttcagcctgggcaacagagtgacaccttgtctcaagaaaacaacagacttatgtacatgtaatcatcttataaacccttccatctataaggaaatcttctcctccctcctgtttcctgttggtcatttataacttctcaccttgaaaagatgccctttgacatgattttaatctaatttacttcataaaaatgtttctggcagagaagagtgagtaaaaaaggtatttaaggtgaggggagtgtgcaaagcaatatttgcttcttagagaaggctctgtttgtgagcagtggccctgtctattcctcgcaaggttgccaatcattaggtttcagcaggtgtgaaacctacagggagccaagtggaaaatcagaagctgcatgggccaacggagcaatagtttggaaggcattgggatttgaaggtctttgatattcttgaaggatgttttacttaatggaaattggtttatacaggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctataggtaattaaacaatgcacataggcaaactgctcacactgcttcttttcaataacacaggaggcttaggaggagttcacattctagaagcaacaaagaatccatttcaatcacatcaaagattgcaccctttcctgctcattctctgtatgacacattaagtcaatgttttctaactaggagggaggaagatgggggcaccttacctaaggggtaggatcagagtctcagcaaggatgggcggatgtgtgcagtttgagaatacatgttctataaacccattgtttctcctatatttaacttatatgcaaaccatggaaagaaaaagctcaacagcatcctttgggttgtaaaagctagcatgagaaagcactggaggggataagagatttagaagattgaacaatatgccactagagaatcctcactacaggtcacactttggaggaattgaagcaaggttgggttaagatcttgtctttcgagttaatggttgcagcacaccaacatggtacatgcatacatatgtaacaaacctgcacgttgtgcacatgtaccctaaaacttaaagtataataataataaaataaaaaaaaagatcttgtctttacttgaatacgtcagcctaggaatccgttggaggaagttttcaaaacttttagctaggtacaaaattctgattaaaagcttccccatacaggattttttccaaagagtgatatcctaccccagtaaaaattaagatctgttaaaacttacatatttctgattgaatctttccagtctgtattctatgaatccctgccttcttaaatagatgatactgagcatattttgcccctttcttaatgacctgagttattataaacatcacatatgatcttttgcaggcagctgtagtgcaataatggcctcagggcaggggatgcatgtcaaggccctgtacttaggtgataaatcatccagactctttagactttattattcttgtgtttttttttgttgttgttgtttgttttgttttgttttgttttgagatggagtcttgctctgtcacccaggctggagtgcagtggcgcgatctcggctcactgcaatctccgcctcccatgttcaagcaattctctgccttagcctcccaagtagctggaattacaggcgcgggccaccacacccggctaatttttgtatttttggtagagacggggtttcaccatcttggccaggctgatcttggacccctgaccttgtaatccaccagccttggcctcccaaagtgctcgaattacaggtgtgagccatggtgcctggctaattcttgtgattttttttgatttttatgtttctcccggctgtgatctgactttctttgttagtgtatgcctaactagaacaatcctcttctactgttcatttagctgcttttcttctgctgtggactgggaaaccagataagtaacctcattgaaagtagtatggaaaatcagtcagttgactctgatttggaggtagaggaaaagcctttaaagggaaatatattgttattattatttgagacagggtctcgctgtgttgcccaggctggagtgcagtgacatgatctccgctcactgcagccttgcctcccaggctcaagcaatcctcccacctcagcctcccaagtggtagggactacaggcatgcactaccatggccgggtaatttttattatttttgtagagatgaggtctcactatgttgcccaggctggtctcaaactcctgggctcgagtcatcctcctgcctcagcctcccaaagggctgggattaaggtgtgagccaccatgcccagaccaggtatattatttttaaagcccacaatttttagctgttatgtaaccctgttcagaggcctttaaaaattacctgcgttctgagtagttgaggttgttctctgcctggtccttgaataagtgggtattatcattgtgatggtcaaagattcatgacatatgtcattcatctagtcttttgatttcaacaataaacgaggctttcaagttttagtagcctattggtttatggctagaactaaggatttttattgttccttatgatagtggacgaacccaaaggcaacttttggaatatgggagaaaagggaggctgaagagcttgccatttgaaaggtacatgattttgtttctcttgctcgtgttgattttatgttgaatttggagatttctatgtatcctggtattcacatgaaggtcatttcaatgacttctctgcttggggatttcaggaaacattacccatctcagtaccatgaacgacagtgcaggtcctcaccagacctcctctctgatgtgtcaaaacaagtaaggtttctgaaaatttctacttctttagataaatgtaatttgtgcaaatttcaaatgcttccatgaattgattctgccagaatcccagtgtgtaaaaaggttactctgtttgagtaggttagcttcctggggaggtctgtcagctcagtctttcctgccaatagaagatcatttagtaaactaccactggtgtgtaccttatagactggagagaactggcacatcttcaaattgcaacctgtgttgctaacatcttgcaaaatgcagatccaaatggctttgaattttcaaaactgaaagctccatctttttacctatgaaaatcttaaagtgtagaggaaggtataaggtcttgggttaaagttttagagtatttttcctgtgtaattttgtaacttaaggacaaagtgttgttcccttggaactgtgagatgatggcttcctttgacatttttagtatgaaaattgtgaattatttttcttttactctccctaaaaaaataattataggtctcataaaccctcatgccttcaagtcactggcagtttttatccaaaaggcatcagaggcataatgatgaaaggagccatttagtatatgaacctctcataccattcatagccctcctcccaccattttacagaaaatagggaggaagctggagcagcaaggttaggagacttgtctaaggtcacacagcaaatcagagacagagccaggactaacaggcaggactcctggttcactaatatagctattaaaccaaactgcttgtagtgtatacactcagagtctggaagtaggatggcattgagaaagaatagtgtcacatgtactttttaacacatgcactgtgatgtagtagaagttattaccctttctttatatatttatctaccctagaatagaacatggatcttgttaaatgactttatgaaaaactacctttcaaactttgaggctaatttagatccctcccccagccctaaccaaatggccttttccttctttcaccaatgtgtccattctctcaaggtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagctta

SEQ ID NO: 3707 - DNA, 51025 bp, human
aaatgcccttgggtgtgcattacttcaagcaaacggaagtgtgccccgctgacagtgggaatgcctggctgggggtgggggggcccgagtgcaccacatccagctgggagtgaaattcctggagaaagcacccacagcactctgagcctgcttgcagcccaacggcctcgctgagaatgctacatttaaaagtgcagtttttggatgattcccagaagatttttgtggttgatgtaagtggaaatcacattgctattattcctttattattcattcaataattgtcatttgtgaacagcccattagagagcaatgttatgtcttctttaggactgaatgaaggaggactgtgatttttagctttggaaaaataatctgtatttaacatcacaatgtagttcatatttttccattaacctttctcttagaacaagttgtcttttctcaagggacaacaatagcaaattttaaagacaggataactatttgcaaaaagtaaagcagcaataaactagttcttttacccaataaggtattgttgttcattgaaattatgtctgtgggtctcaccccatgagcatttgtggggagaaaactgttgttctgagggaaaggagtgggggaagctatcctccttttctgaagaaaacctatgggttataaggggtagaattatgtagttgtaatgagaacttcaggaaggaatgacaagtatgagagagaaaaataggataagagactatttagtttgatttagtacttatagttcagagttcttaataaattcctagctacaagatgattgcatacaattatacctcatctcttcaagaaagaacaaatgtattaagcacatcatttggtgctcatgttccaacatcttaagatatgtacattttgatgtcaggatttatgtatgagcattttgaaaagttctacatttttattggaaccaaaaatgctatttgctctgatatttacattagccactaacaagagacaaatagtttattttctctgaaattcatacaaaatgttggtttttttcttttatacataaactgacaactgctgtggctcagccatgatgttgtgtgtgtgggtagcccatttttccaatgagtattttatttttatttgaatcatgtgctttgtgagtgatgacttcatgtcttcatctgctgttttgctgtctcttcctttcagttttatgcgcaaaaggcatttctagttccacggacctgaatgatttgtttttgtagcaaatagcttccattagaggtatgaggcatttcctattctttcttggaactatatttaaggggtggaaaatatcttttgagtagtttatccatttgcagactggtggtgtatgctcacagtgctgcagtacctgaattagtgagctgggtattcaaaagatattgctttaggctaagtttttaatagatatttcaaggaactcaaagagaaatctttgacaaaaagtgacagaagagtttgttgaatgtgcagtctaattcagatccatttaaatggggtggagggtgggtaaggaacacagtaccatatcttcacaaaattcacctacggaagagccacttccagcaactagaagacttgatttggcttcaagtcaaactgtctctttccagctgcaacacattgtgttccttggaaagataatgggagagatttgatacccagcaattcaggtgtcaaagcatgtgatcccttttgctctgtggaagaatgctttgtaagtagcaaccatggtgttacccagagaggcaatagcattggctgcagtactgtgagtggctttgtccagaggagttagaagcttaagttagcattcaatcatccaatagtaccttctctgcttaacaataatagattgatgatgatgatgatgatgatgatagtgatgatgatgataatggtggtgatgatgatgatagcagtagtgagtcatctgtggatagcactttaaaatttacaaagcactttcacatccattagttcatttgatcttccattcagccttgtgagtgaaggtagggaaaagatcttttcccattttgtaagttaaaagatggaggctcagggaacttaagtgacgtgtgcacaatcacacagcatataattgcagagctggacttccaatccagaactctcccctctccttcatatacaattgtaaacagtagactcatctgtcagtagccttcagtattgccgatgcacattatttattttctgatgacctcacaaggcatagaacttggcacacagtgagcttttgatgactattgtgaaccagttagtagacccttcttttcttaatcatggttgaagaattatgtgggacagtgttccctcaaggtcagggagacaatggtgtgaatcttttcacctattcaaacacttaaaaaagcaacctaaagaatgctctattttattagtactaacattccaaatttgatgaagaaatgcttggaaccataatgaagagaacccattgatagctgaggaaggccacatggaggaccttttgatactaaactgaaatctcaagaggcatggatcataaccagggaaaattgtccttcaagataagattcaagaaaataattggttgcataagggaacatagtggactcttgggtattggtgttgattttatagaaagtgcagtggtagaaatataaaaaggacacatgatcagataaaataatgtcacctggagaaagctcattgacatccagaaccctttctccacccccagtactattatcttcctgaatttgccagtgtccaaggtctaactcaggcctcctgactaagaagcctgttttgtcactactccacaagaactggagtcagagactgacatttaaaattagaatgctagtgtcaccatttacagtgggattggggacactggggtcctctcatcatttatatgccaaatgatgtcagaagagccagatctggaagaattagatatatgatcctaatattcgatggcttggtaatgcatctgtgtccacagaggccatggcattgagaccttttagtcacgtattcattaattaactcatttagttaacaaattattattgaggacctaatatgtcccaggcccagttctgggaacagtagactctgctatattggtaggtaaagttcgtgagcaagagcacactctggcctggacatactgcctggatgctaccaattttggccttggttattcctttttctgtcattgcatgattgacaactccgctttctgatcatcctactgtttttaacttgttaatactttcagttagtttattagaaagagtggctgctcccaaatacatcttgttttcctgaggtttctttgcatatttgtgctctgagtcacttggtgttgattttatagataaattctctgaaaatattagtcaaccttttctttcatgaacttccaatagtgtttaggggtgcaggataggttatgggacttcacaattgctagaatgtgcctactaaagtacaatccaatgaagaaaatgaatttagtgaaaatgtcatcttacttttcaagccctcatatttatttcataaactgatcattgtcaaatattagcattattcttagggctgatcttacaacggacagcttatctttagactgtcaaggaaggctctctagaatgatgatgggagtgggtgagtgagactaaaaattgaataaggtcatgatttacaaattaattgcaggttttattgtatatttggttttgcttcttcaacatggagactagaacttttcttgaaggaaaaaaggaagataagaccaaagttaaagctttgtgagatattagaaacaatagagggtcaagtttctagcttgactatcaatctcttcaatatacacacatgcacatgcatgtgtgcacacactctcacacacagtagtagtgatgagtgcctttggagagcaacctcttgtttgctcatctcaggttacatagagagttgtacaaaatggtcatcccatcaccgtatttgacacagttctatctgatatccctttttgcctgctgcatttctgtctttgtaaaagctgttatttctgaatttccaaaatgatgtttcactttgatggtttctggagactaaagtcaaaacgagatgttaaaacatctctactttcacatttacctgattgctaagtgattgtactggccatgcagtgggtacccagtaacagaatatagtaagttagctcacctgattcccttgggagcccatgataaaggccactaggcctcatttttggaaagagacagagaggcagtgccaggaccgaacactgttcaagttaagtaggaaagcaaagcacagtgatttttaaatttattagtggtggaatttacccttgggatgtttgcccaggggttggtttttaaatttgcgatgatgaaggatcttttgtagtttagtcaacagtgaaatagataactgattctgtcacttcataaggcaaagttcttccaacttcaatgatatgaaattgctttggtgtaatagaaggtacctggatttgggactacaaaaactaccaaaaaacccaccactttagctatgtaatcttggactaatcacttatccccttagcttgctgagttgttgcgaggagtaatacaaattaggtaatgtatatttggagtctgataaaccaggatagatttgactctgccactgacaagctgtggagccgtgggtaagtcacttaggctatttgagccttagttctgtcaactgtaaatcctagacttggggtgccaggaaaaacttccagaagaacaaaccatttaagttgctgagtaggagttaagaaggtgaagatcgagaggtagattgtgggggaagtatggtgatctacacaaagggaagaacgaaggccaatattcaagagaacatggtcctttcacagaacaaaagggtcaatctaagtgaagaatggagtattgaaaggaaaatggcagtgactggaggtcaaagttgaagaagaggttggcagctagacctttcaggcaatgtattctatatgtgaagaagtgtgagaagtgtggtctttatcctgaaggtggcagagaccactgaagggtttaaaagtggggacattagcctctgctcatcatgcattaatttatgcatttattcattcagactatatttaataaaaatatgttctaagtgctagagatgccaggtagaatctgaatgttaccatcaagtttagtggatccaattttagagggtcaaactatatccaaacacatatgcccaaacatcgatattgcagcctactagggttctgaacttcgtcaatggtgaagacagacaggaaggatgaataaaagacatgctaatgaggtagaatttctagaaccatttgatgccacacttttggatatgggagatatgtgagaaaggatctaaatgaccttcaagtttctagcttaagtggctggtgggatgatggccccattcaccaagatagagaacagaatagaaggagcaagtttagaagggataatgattggttttgtttgagatttatagatgggattatggaaggaaaaatacatctggagtagggcagacctgaattctagaccaaaccccaacaatttgaaggtgtgagacttcaggtgggtcacttcagctctctgaggatgtgcccttatcactaaagtggagatgatcctagcatctacctcatgagatcattgtcatgataaatgagatatcagggataaggttcctgacacaaagcgggtgctcaaatttgttaattcccctctccctggcttacagacctccttatttctgtactttgcaaaccaacaaagaacagtctttcactttcaactggactttcttttgatgatgcttgattttgcaacccacctccaggtaatagagctgtgctcccccatttctgcgcttcctgtagggttaatttaccctgcctttttgcatgctttggcctctgtttactcagcagccccaagagatttgctcttccctttggagtcattaatcctggaagggtccataagaactccctagagttacctaaaataatgtagggcttcctttaaggaagcagatggaaatagccaaaccctttgcattttactacattctaaattgttccatggtcattattcacagttagggtaatacagttaataataataacaataatattactgaataataatcacaaatagcatttatcaacaattttctagatgtatttcccatgcactaccttacataagtctcatgcacatcaaataagtgtcactgactagggtttttatataacttctctgtgccttgggtttttttttttaatctataaaatggggataatattagtacctgctccatagggtcctaacaaaggttaaatgaattaatatatgtaaaacactcagactagtactagaaagtgctatataagtgtttgctacactcatgcctcatggaattcactccaattttagatggtgaacacatgtcctgcttcttatgtccaagcagtaatactccaagctgactaggcctaaaatattatgtttatctctattttatgagtatgtgaactgaggcacagagaggttgacttacccaaagtcatatggctatttaagttaacaggtgagctgggattcaagccccactttgtctggcttcaaaatcctgtctggacattgattagatggtaggcttctgactcaagcgtgatttctgtatatgcagtgaaacttcctggttttccagaactttatgatgtatcctctagcagatacatcacaagcagcctgcctaaacagcctgccccatgctaggtgggatcaatcgatgtttgttgatagactgaccaacagactgagcagatcagctcaccaccaccccgtgcctgtacaaagaaagccaagtgaaggagcttctaaacccaggtcagaaagatcatcctggaatcataacgttccaatctagccaatgttggctgtccctttgccagggattcatttgtcattgcaggggacccatactgcttggtgaatgcctttgtttaaactgaacttcctctgtcgttcatatcctgaggtttgttgctttggagaataaattgaactgaaaaaaagtgcttgtgctttctctggccccaggccaggctgagcagtgggtcaagcatggtttgggtgctgcctgccccaccctctgggagccccacatctcctgctgtcacatggcttccaggctgctttcctgctccagttcagagcaaaggcagggcctccagccttcccactcccactcctacctgccccttggcttcccatccccacagctgaaaggaggagggaacccgaacgcaaaaacatttgaggccatggcggaagagattggggaactggctttggagctataggtgggtggcgtttggctgtttgttcaagtctgcactcgtgggaatctctgtggaaaatttcagttagtcggggccttgccgcctcttcacctttcatcgcagggcaggcctgcctgctgcctggtgctggggaggagtagcagaagttggttcactgccctgcagccagaacgatctgcagatcttccctccgaattagactcgccagagatgattcctctgaattctataggagtttctctctcccgcttttaaataccctgcatttgcatcattgttttgacctgtcacaaacacaaatgtattactctaataaaggcttaactttaatttgtgccttaggacaatgaagctgtcagttgcaacttggagaaattcttcaaactgactgagctgagtccaaattgtcttggggtcaaaagggcatggcctgagggggaaaatcatctgggaggcggctggactggcccagtcatttcctaaaagagcctggagactgccagcccagcagcagggagcagtgcctagcttttgtgatactaggtgcctcttagcagctttgtgccagactgtcagaactggaaaaacattccgtgagaccagttctactgctgagagaaccacccttaacagttcatttacaccccaggaggtagtgccgagctggccaatgaggtgctagggcaaggcaccactgagaagacctgctgaaggctacaaagctcaggaagaatgaaaggtgataggcgttccgaggaacatttttctgggggctgcggaactctctgatgtatatagcttgcctggttctaaacacagctgctgtgcaaaagctacaattattacccccacatcatctaatttcagcccctttttctgtattccttctcagcctctttacccacttcctcctcttctgggtccaaggtgtggggccagaaaggggaggtttggctgggtgagctgaccccaggccctggaagcacttaggcatggcgcttcaccactaatcgctgggcttagttgtcttaaacaagaggtcctttgtcctctgagattccttctatgatgacgaaattcacctttcaacagacttttaaaaagacaaagattctccagaacttcacactcagaacattttaagtgattgtaagagatctgtgacaaagttactgtcaattgcctttaatgctatgagatttcatttcctgacctagctgcatgccaggaacttccacttacattatttcatacaatcattacttaatacgtctgtgaaataggtatgattatgctccttcattcattcatcactcacttaacaagtcctcactgaatccacacactgtgttggctattgaggatgcagagatgaatgagaaatagtacctaatctcaaagagatcatgggctaggggaagaatcagagatataagcaggtatgtatattatggtgtgatgtgtacaaatgacagtggaaaggataatttttttttctagcacagcaaaagaggggcatctaacctagattgaagtgtgtatgtggaggggacggacaggcaaggtttttctaaggaaggtgatgtctaatctgaaccccagatagccagtactaattatttaggtatgtgttggggagttggggggctgtgggggagcagagatgaaggttggtccagacaaagggagaagcaggaaaaggcctgtggagtaggttaatctgattgaatcttaaacttgagggcagaggggactgagagagagcgatgagagactgagggctgagacaggagagacaagcaggaactgatgagacagctaaatgcccaggcagataaaaaggggtccccagagaatctctggcccactccacaagtgtttacatcagatgcttttgtgcagatgggggaacctgcccagtgccttgtctgagcatgcccacatgcgcactgggagaacagggtggagccatgggcagggggaggagcttggcctccagttcctgtgtggtggcctgggattcaatctgtgaggtcagggacctattagcaagagctccatctccctttgctgagtttttttttttcttttttcccttttttgcccaataaaatcctgccctactcactcttcaatgcgtctgcgtgcctaaattttcctggtcgtgtgacaagaacctggttttagctgaactaaggagcaaaattctgcaacacaaagtcataaaaaagatttttcaaataaagaaatcaaggttcagcaaggttaaatatgagctcaaggtcatacaactgcaagtaagtacttgagtcaggaattaaaagtagatgcgttcattccaatccccaactctctcccctatggtttgctgcctctggaattctgatgcacagtttgggttcatataattctttcactactttaccaagcaagaactaccactgccacgattccttcccataatttgtattcatatttccgtatttaattaaagttttacacaaaaaattattagacattttagtatttaattcaaagtctcaagcaaaaataagacaaccaaaaatgtaccccaaataagctgggaaaattcagtttctggaaaaatgtatcctaaggaaataaaattttatgtaaagatacatgtacatctttgtgtactaagatgtttattttagtgttgtttgcaatagctcaagggagaaaacaacttacatgtccaacaaggtagtttcatataacagtaactaatgatgatattcacaatataatactacatttttttaaaaaagttggtcaccaaaaggtgttattacatcacatgcattgagctttactctgtgatccttagattggctgtctcttgataggtgggattaggagtaccttatttcttcttgcttttctgtttcttttgttccctgctttttaaataagcatatattgcttttggaatgaggccaaaaaaacaaacaaaaaaagagaaaacaataaaagaatcttcattgaaaacacagttccaatgataagtatgtgaggtaaagcacgttacctcgatttagccattgcataatctgcatattttaaaacatcatgttgtacatgataaatacatataatttttattcatccattaaaaataataaataaaaacagttgctgtacatgatccactacctgcataagcaatcaaaagagggggttcttctcatgacggcagggccacactttcccagatgctcatagccacattatgtgatatgtataggttctaggcacttgctccaaaatatcaaccccattccctactagcctacaattattactcttttccaacctaaatagtaatggtaatagctaatatatatcaacagaatgtttattatgtgccagacactagtctaaatattttacatgtatcagctcattgaaatcctcaatgaagtaggtgctaccaatattcccatttgacagatgtgctaactggaaagaggtgaagtaactttcccaaagtcacagaacagtgagtggtgcaaacaggatttgaacaggggcaagctggattaagagcccatgcacttgaccactccatccactctttgaagctagtccttcaagaaccaccatgttgcagttatctcagcattttattttatttattttattgtatttttagatttcattttattttaagttctgggatacatgtgcagaacggacaggtttgtgacataggtaaacgtgtgccatggtggtttactgcacccatcaacccatcacctacgtattaagccccacatgcattaacaattcatcctgatgctctccctccgccggccccaaccctgacgggccccagtgtgtgttgttcctctccctgtgtccatgtgttctcattgttcagctcccacttatgagtgagaacatgcggtgtttggttttctgttcctgtgttagtttgctgtatctcagcatgttatatcttaaacggctcttatttgtgttgggagtggttgagtaaaaaacagggtcagcagttgctggtgaagtgggccttgtaagagctctgagagagctttcatgtacaaatggaaaatggaaacggttcagagaaatggacaaggttagaaaaatacgtggcatctgagaatcatgaggccagaaagaaaggtcattctttggagctcagtgggtggggttatgaggccaaaaggatgcagtaagttcctttaactttgagaaggcaagcaatagttgttgaatagttactgcttactctgaaacataatagatgcttagtaaatatctgttaaatcaatgtaagagtggattctgttcttgctctcagctgctaggcagctaatccttgctccaatgagttagctgatataatgtcagtcgataaaacattctaggaagttaagtgttaagtcgggaggggtgtggtgcaaacatttcatgtgttagagtaataatttttttcctggaccagccctgcacacatgtgaaactgtgtggtcacagtatgccctcactgactattcgaaatggggttgccagaagaaatgagaaacgccctgcctcagacttccccaaagtataacaaatgagaggtcatctctattcctaggaatctacaaagactcctcaggtttctctgtggaagccaccgtgaacctgtttattcatttctgcatttggaggaatgtggactagagcctcctaagttgagaaaagcaaatgtcaaattcgacattgagaagggaagaatatctttggttttgatttttaaatagcaatgagtcagcttaaccagatccttctgtacaaataattccacctaagcaattaaaggagaaaaatattggaagatcttgcattgggagtgtacaactaattttaagacacaaaggttagtatcccttgggatgtagtttcccattaaagattgctaataagttacaaatcctaccactactcccttctcaggtttcccacaattttacatttagaaagttaaaccatgctttctctttctctcttgtacattagtcttttagatgtgtagtacttaaaagaaatgcatgaaattaaaaatgtcctgggtttggctgtacttgtacctgggtacaattagagaattccagacaactgttttgagttatgctgcataccctaaaaatagagccaccatatttaaatagccttgaggagaaaggatggcagaggtccttaaatctggggccagccccagactaatccagactgagaagaatctgcaatcactaggcttacaagttcaagtcactccaaggctcacaagtgtgagttagcacttaggactgggatgactacaggctggtgtaggctaaaagaaaaggggcagaaagctgtaagcaggccccggagttaagttacactgctgagctgtaagcagtcccaggagttaagttcaacaaatctttgagaatcacctacagtgtgcacgacatatgtggtgatcggtcaaggagagagcagacctaagtggaatctagctggttgccattgtaagtccaagttagtatcaaacagcaggaacccaagtgaagagactaggtgaacatcagggttaggaacttggatagatgtgtgggtagaaaaagaagagtgaaataacaggtcctaagtgactgctgcaaaggtggagcttggcaagaagccaagtcaagactgaggcaggggcctcttgtatgtttcctgctgtagggcagaactggtcccttagtgtagtccacaggtgtcaacaagcaagcacacctggctaatgtggagatgtggaaaggatgggaaatgagacactcctggacagggagatcagcttgagtgatagctcacatgacatctcatttttgctaatcagtttgaatcctatagaggttgtatatttttaatttaaaattttatatccagcttcaaaaacaatagaacctaagttcattataaatagatgagaaaattcggtaaacaaatgaagaaaataaatttcaagtataatcctaccaccaagattttaacattttggtgtgcattttatacattgaaattctacttctttaatggacccctaaattccacatgtgcctccccattccatttagtttggaatagtttcctgaatatatttaaaaaggttttctgttcagtcaatgcagattccccacagtaaccctaatatgctggctttcatggcctcttagtaagtagatgttttataaggcattataccttgatgacttctttatagggtttctgtgaaattcacaacctgtcagaacagcatggcttccaacctgctcacagccctgctgggcaacatagtgagcactgtttctaaatggagtaaaactgattctaggaacaaaagagacagactcggggagcaagtgagaaaagggaggctaaaggagaaggtgaaacattgaagtcataagcagaaggtgggaaaagtgagtcaaggatagagtccaaaggtgagaaaagataataaagtcaggtaacatggttaccagaggctaggaagagtagtggggggttggagacttggggggaggtggggatgtttaatcagtagaaaaaaaaatagaagaatgaataaaacctgctatttgatagcacaacaaggtgactatagtcaataataacttaattgtacattttaaaataactaaaagagtgtaattggattgtttgtaactcaaaggataaatgcttgaggggatggataccctattgtccatgatgtgcttatttcacattgcatgcttgtatcaaaacatctcctgtaccccataaatatatacgactactatgtacccacgtaaattaaaaaatgtaaagtgaggtaaacagagtgactatgacaggaagaaatgaatgaaaaaaacaagttctagctgtttatctctctcttatcattcatccacctagataatagttttctctttacatttaaggagagcctggcataatgaaatgagcccattgctggaggccagaagacctgggttccactcccaggtctgccattaacctgctgaaagatcctaggcaagtctcttacctgctctggatctaaatctccccacttgtaaaatgatgggcttggagtacatgatatctaatggtctgttttgtcctgggtatctcatattgctaggtatatacagaatcaatttcacgttaaaatataattccaagtaccatttagaatttggttgtgtatcatgcacaccacatggatttaatgttaaagtgttatgtggagacaaacaattataattgttttaattacccagagtagctagtaatttctataagacttgggagcactgtcttaagaatgctattattacactgtcacttttcaacagtctttccaatttaggcatgataatttcaatgtcccaggagtggggacaagattgctattaggctgataatcttactggtaatctttttcttcacccctgccccccttagtgtgaaggttaacgctgagcagtgagagtctcttagactccatccagttacttcaccaaagaatgtgaatcagatgcaacctgtccaggtcattgtcaggcctgcataaggcctcaggcaattatatataatcacttccttgtagctttgaaaaggtgtctgacagaaggtatcatctatcaggtaccggactagctatctgattccagagttctcttcctagcttggtttggttggcatcaacatggctgtggatatagggggtggtggtcaggcagctgttcagcttgattctccaggaccccccaggatagtcacgtgggccggaaatctttctgggcagttaatcctaagaaacgttaagccttccatctttcacacatgcagcactttgaactgctttatgttttcagaaataaaataaaaaccagttgtaatttggtgcgaatttcacacgtgcacaagcatctaaaaggcttgttctctctgcttacccccaccaggaaaccttaagtacccagtcaaactgtgcttccctccagggtttattgctgagtcctgtgggctctagggaaagggccttggttccttcctacttattctttgttctttgatgtgtctaactgcaccttgctctccaccagatgctaaaaggttagactgcctgcagagaactccattttagaaggaaccgctgctacctggtaattagcctctcaccactcttagcagttttccttttaccaggagttaaaaccccaggaagggttacagtttggtcaatgaatttcttctgcctctgccctgaaggagctccctttcctcgttccctaggtgatttactgagtgcaaactttcaaattatgttcagcttatttcctagaaaacttgttgcagctgcctatattggtataggtgtaaaatatgagccttttaaaaaaatgtcagaacatttgcatttttaccgaaaagtaaaacagtctttaaaaagaatccctcctagggtttattcctcaagaagttctgagattcctggatgtagcctgcagaaaaaggcttaccttcagaggggtttaagctctctgtaaataaggtgcacacctattgatgtttataaacagagctcagtcgaggtgaaggagtgcagaccaagatttcaccagatggctaaaattaaatcagcataactgaaaacatgcttagcctagaattgcactaaatggtgtcaaaatgcagaactatctccatacttcctgttctaattaacacaagtccaatcctctcactggagtgttctgcttggttctggcttccaaaatgctattcggagttcaggatttgaagagtaaaagactgatggaaattagccagaaggaactagttcacagttgtccccacaaatatgctgaatgacaatgtgcttatactattatagatggaactggttctgggccagtgccagagtgggtgattggggtaagttacaaaagggataatacatggagaagctctgaggttcaccaaaagaccagaagaaaaataccagatggttggccagacacactggctcatgcctatagtcccagcactttgggaagctgaagcaggtggattgcttgaactcaggagttctagaccagcctgggcaacatggtgaaagctcatctctaccaaaaatacaaaaattagccagtcttataactcagtctcaaaataagtaaataaatagataaaaaatttaaaaacaaaattaaaaaattaaaaaaagaaaatgccaggtgctggacttaaatttttatatttatttttctttttatttgagacagaatcttgctttgttggccaggctggagtacagtgatgtgatcatatttcattgcagttgaactcctgggctcccacctcagcctcctgagtcactgggactacagggatgcaccaccatgtccagctaattgtttaatttttatagagacagggtctcagtatgttgcccaggctgctcttgaactcctggcctcaagcagttctcttgccttggccttccaaagctctaagatcacagacatgagccactgtgcgtggcccaggtgggtgactttaaaaggaactggtgaacaaaataggttgtcagaaggagatttcataagttaatgccagcagaaagcttttgatatgagaagccatgattttcttttcagacctgtgcaaaggctacggagtgttgaaggaggggttcaaatatgtgcacacattggtgaggaatgttctgagcatccccactctcagataggttggtgtggggagaattcagtaacaagggatggagagtaagtgaggcaagctgcttgggtagccccttgttgtgcatgtggtctgtgggccaattggtaaagaaacaaatgtcaaggatgagcaaagtgatgcataaaggtgaatgaaagacggtaaaatgaagcctaaactcagcgatgatggacgcaaacccttatcccagcagaaggcaaaaggggagcaagcctgtaagacctgcaaagagaataccaggaatctctaggacactctctctctcttaacctccccaagtccaactgcacctattacagagccatctctcctatctttacctctttgtattctcactaccactgtcttaatccaggctaccatcttctctcacctgaattatagcagccccaacctgactacctgtcacctgttttaccccctcctccacctatcccttaaaccatcattcctcaaagtgtagcccacagaccagcagcatcggtctcacctggtagcttgttagaaaagtatattctcaggcctcaccacatatctatagaatctgaacctgcattttaacaagatccccaggtgattcatatgcactttacagcttgggcagcagtgccctaactacttttaggctgctgtctctaagacacaactctgaccttgtcaagtccctgctgaatatcatccagctactcctaaccccaccctgtacctcaccttcaaggcacatggcttcacatgccacaacaactccccttggtatgacttctgcccacttttccagccccagggtctcattttctcctttagcaacaccaaactgcttgcagtttcattgttcaaaccaggttttctaatctcttctgcctctaacactcttcttctttccgctggctaactccaattcttgcttcacacctcagcttagatgtcccatctgttaggaatcctttctactacgccctcacccatctttatgggttaggtgatctcacattaccccctgcatacatccctccacaaaatcacttagctcaaactgctgtgattaaccatggatgtgcctgtcttctctgccagcctatgtgttccttggtggtaatgcctgtgtcttgttcatctcagtgtccctggagccgaggagagtatgtggcacagagcaggtgctcaataatctgtgttgaattgaagggacagtagaaaggatcacaaaagggtaatggcatacacaaaaaggaaaggaaagggcaggcacatgaaaattaagcccagagtttgggcagataaaaattacaaacaggaaaacaaaagagctcgaaaaatacaataaacaatagagtaaaaagcatactaaaggagagatgaggcgttgacttttaaagtgtttattaaggagaaggttaagactgatgaaacagttctctgtctctgtttttgtgtatggctgttatggctgagacttacctatgaaaatgtggaatcagagggttaaaatgaccaaaaggtaattcatttacttgccacctggagagatgatcagctgatactggtttatctgagagaaaaccaatagttatgtgtgtgattctaaatattgcagatcttgaatattcaaataaatattgcccttgtcaaaatagacccctcagatggtgcaaatgctaatagctaggtgtagcctgttctcacactgctatgaagaaatacccgaggctgggcaatttacatttgtttaaagagctttaatgattcacagttccgcatggctgggaaggcctcaggaaacttacaatcatggcggacgggcacctcttcacagggctacaggagagagaatgagtgcaagcaggggaaatgccaggcacttataaaaccatcagatcttgtgagactcgctcactatcatgagaacagtatgggggaaacctcgcccatgatccaattaccttcatctggtcccgcccttgacacatggggattattataattcaagatgagatttgggtggggacacagaaccaaaccataacaccaggtgaccacacaccaggatttgtccaagacaggcctggtttatgcctgttgtgataatatccttattacaagtgccccttgttatcctctaaagtgtccaggttaggttcataaattatatggtcacctagaagtagtcaacacttattgagttcttcctatgtgtcagacactgtgtaaagtactttacatgaatattctcgctagaagctccctgtgatcccttttgagatagacatacagttcacataacagtaaattaatcaaattcatccttttaaagtgtacaattcagtggtttttttgtatcttcattatgttgtgcaactatcccaaccatctaatcccagaatattttcatcacctccaaaagaaactccatgctcattattattcactcccacccagctgctggaaaccactaatttactttcagtctgtagggatttgcctattctggatagttcataggaattgaatcacataatatgtgactttttctttctggcttctgacaattctattttacaactgaggaaactgaggctcagagagattaagtagcctacccacgatcactcttctagtggtagaggagtcagaactaggcccaggtgtgtctggctccaaagcaaacattcttagccaccatgctgtgctgccacctcatatttattgcaagggcttagcacattcttggaactcctctttggccctctgtagctgggcacattctttccaaaatgcctcacaaatcttcattatttgagagggaatttagtgtttgggaagagccaaaagtcataaaaagcaaatatggtaacaaaagtggaccatcaagctgggtcattgctatagactgacttgtattctcccaaaatttatatgttgaagcgctaaccctcagtgtgactttatttagataggacttttaggatgtaattaaggttaaataatataaatatggggtccttatctgataagattgttagctttataagaagaggaagattctccctccctctctctctctctctctctctctctctccaccatgtagaaatatagtgaaaaggcagccatttacaaaccaagaagagagcctttaccacagtccaaccatactggcaccctcatcccaggtctccagcctctagaaatgtgagaaaataaatttctattgtttgagccacccactctatggtattttgttatggaagcctgaactggctaagacagtcatatttggggataaaaaatgaggcataaccataaagtcaggagaatgaatgattatcatctgtgactttgagaataatttcctgaaggggtcataagaaatattttgaatgccagagtcagcattggaaacaggggaagcctctatctataagacattttgtatgacactatgcttttaacatttagaatatctattgtatttctctggaaaatataacaagtataagcaaaaagtaaaaataacccattatgctactattaatgatatgctatatttccttccaatctatcttttcctgaaaccttaattgtatagtctgtatttttttaaagcacacaattaatatgtaagatacattaaaatttctctctttttaaaaatcttttaattttaggtttgggtgtacatgtgaaggtttgttacataggtaaatttgtgtcaagggattttcttgtacagattatttcatcacccagctattaagcccagtacccaatagtgatcttttctgctcccctccctcctgccacactccaccctcaagtagacctcagtgtctgttgtttccttctttgtgttcataatttctcatcatttagctcccacttataactgagaacttgcattatttgattttttgttcccgctttagctcgctaaggataatggcctccggctccatccatgttcctccagaagacatgatcctgttcttttttatggctgcacagtatttcatggtctatatgtaccacattttctttatccaatctgtcattgatgggcatttaggttgattccatgtctttgctattgtgaataatcctgcagtgaacatttgtgtgcatatgtctttatggtagaataatttatattcctctgagtatatacaataatgggattgctgggtccaatggtagctctgcttttagcttgttgaggaattgccatactgctttccacaatggttgaactaatttacactcccaccaacagtgtataagtgtttccttttctccacaaccttgccagcatctattattttttgactttttaatgatagtcattatttttaataccatttgaattgcgtgaaatggtatcttattgtggttttgatttgcatttctctaatgatcagtgatactgagttttttaatatgcttgttggctgcatgtatgtcttcttttgaaaaatgtctgttcatattctttgcctactttttaatggggttgtttgtttttctcttgtaaatttgtgtaagtttcttatagattctggatactagacttttgtcagatgcatagcttgcaaatattatctcccattctgtaggttgtatatttactctgttgatagtttcttctgttgtgcagaagctcttaagtttaattagatctcacttgtcaatttttgcttttgttgcgattgtttttggtgtctttgtcatgaaatctttgcccattcctatgtccaggatggtgttatctaggttgtcttccagggtttttatagttctgggttttacatttaagtctttaatccatcttgagttaattcttgtatattatgtaaggaaggggtccagcttcaatcttctgcatatagctagccagttattcaggcaccatttattgaatatggagtcttttccccattgctagtttttgtcagctttgtcgacgatttgatggctgtagttgtgcagccttatttctggactctctattctgctccattggcctatgtgcctgcttttgtaccagtaccctgctgttttggttactgtagccctgtagtatagtttgaagtcaggtaacgtgatgcctccagctttgttctttttgcttaggatttccttggctatttgggctctttttttgttcaacgtgaatttaaaaaaattttttttctagttctgtgaagaatgtcattggtagtttgatgggaattgcattgaatctgtaaattgctttgggtagtatggccattttaatgatactgagaatgtcttatttcaaatgttgttgaaggtggttgttgatcagttaattgacaaaatttgctaaagcaaacactaataacaaatcatatacatatatatacagacatctcaaattttttattttaacataaaatgtatacattttattcatatcctaactgtttgatatagggtcaagaccttttctttagtatggacttctgattgtattcccttttgtctttcttccataaaccacatccataatctgtcatcgatgatttccagtcttggtttatttaatgtggaacaagaatacaatgatttcaaagcagtgagtacagaatctttccagattttgatgtctttcctccgtcaatcttttattgctgtcatatccaaaactaatttgacagcacatttttggggactcccccttattgagtctttacaaaaatatcaatttaagtttcatagaaacaactcttgccattagtgctcataataatttttgatatacataccatttaattaaatggtgtaattataataataagtagagcttgtcaaaaatattttcaagaacataatcattagtaagcatgggactcaattggtcactgtcaaagtgtacaattgtatttgagtcacctactagccatgagttttcatcacaatgtgggcatctgccaattttttgtttgtttgtttgttttttgtttttttggttttttgagacggagtcttgctctgtcgcccaggctggagtgcagtggcacgatttcagctcactgcaagctccgcctcccgggttcacaccattctcctgcctcagcctcccgagtagctgggactacaggcacccgccaccacgcacagctaattttttgtattttttagtagagatggggtttcactgtgttagccaggatggtctcgatctcctgacctcgtgatcccaccacctcggcctcccaaagtgctaggattacaggcataagccacagcgcccagcccgcatctgccaatgttttaaagagggaatagaatgcattatatgcacattattaagtggaagttggttaagaaagtttctaccatccttgcttattaaaaaaaaaattcagacacgtacagagtaaaaagttaaagtcccccttattttatctcctctccaggaatattgttgttaccaatttggtgtatattcttccagatttattactatgcatatatctatacatgtgcattgctgaagtgcatatgcatatgtgcatgtgcatatgatgtgccaggcactgtactaagaccttgatgtgaattattttatttaaccctcacaacaaccctatgagataatatcactattatctttattttacagattagtaaactgaggctcagaaaagttcagtaattgcccaaggtcacataatgactagtttgtctctctcttaagaggactattatactaatgtacatgaatcaagttaaatgtctgggtccatttatccacttactcagtaaacatttattgaatgtccactttgccaggcactgtacttaattccaagaattcaaacacgtggtttttatcttcagatatctagaagaggtagatcaatctgtgagctaaatgatttgccccaattcgtccagctagtaagtgaagagagcaagattacaatcccgatttattttaacaaattggtatataacaattgttggtgcacagaaaatttggtagatttgtttttagagctagccactttgaatattattgtttccatgagaagatgagtttgaagcccccaggaatcagtgttcaattgttatgacccaataaattaaagattataaatccaagttatgaatgatttgtttaaattatagagatagatagatagatagatagatagatagatagatagatagatagacatttaaaggcagatatcaggatgagacaggattcaggattggagttccaattccttcagtgggaggactgacgggtggtaaagaatttagatctgctaaggagcttgattaggatattgaaaagtaccagcttaaaaaagaccaagcaattgtacagagaatcagaagtccagagaaaacagaaaagagaaagagaaaacaggaagcttgtatataaggcagtattacaagaaagagaaacataacaccaaaattgagaaattcgatcataatggtagaaaaaattaaaggctgcatgttgagacagaaccaagaccttacctattacataacacattccacaaagctggccaatttcaacgtacactatggaggactgaaggaaaatgcctctcgcggagatggggtggaaagcttgagccacatgagtgtctgacctccaaaagcataaatgccaaaggcttttagagccagttggcaacacttacagggatggaagaatcagggaattattcttataaacatagtatgggatcttacggaaggaagcaaaacgaaggccttaattagaaaccttaaaagaatggctacatatgctttgtaattgcagaaacatgtaaatatacaaacacatggaacatggcagtgttgatagggaggattaagtgccctgatggaaaataagaataaaatatgaaaaggagaaaggaaaatcttgagcttcttaaattgcttgcaaaaaaaaactggagtgtatgatggaatttggtcctcatgactgaagtgtttctttggtgttggaaaaagtattgctgtcatctctctctctttagaaattctttttttttttcataataaaaatcccatggcagctccttgtctatgaaggattttaaaaataggagcaatttcatgtgtctgcaatggtctgtgtcagcacttgccctaggcaaggttgccacacaggcaaaaatgtacccctctcccctataaacaggccctccctggcaaccccattcccttggtgccaccccccccaggggaactgacccccttttcttggactacagctccattgtgatctcccacatcaaatcaaaccccctttcccttggtagagcagctctgtctccaggtgcaagggatgaaataagtttcaccctttgcagcctattttcatttaaaaatcggactggggttaacccaaatgaatcttgagtcggtggagctctgggcagtaaaaccaagtagagagaagtccatggggagaggggtgtatttttggacggtgggggaagcgggtgaggtaggccgccttcctgaaaactattaaatcccagatgtgggctctgttcagtgtggtgctgccttgagggaggggggaattggtggtggatggactctctgacctctcaaggttgctgttaattctatgggtcggtgatttccaactacatttccccgcgcctggcttcctttgcagcactgtaggcaccgcgtgactcgcctttaactaggggttttcagcagccagtctttgtgcctatcagccagggctcaattttcccatcacggtcctccctgcaacagcaatccctgggttcagcaatagtggaggcaggctgaaaatcagtcccagccatactcagctcaaagaaatttttcacagagagctcttcaaagctcctgttctcagagaagcataagaaagggactgttttgtgctcacagtgtgtgtgggctttatgaagaaaaaaatttgtggccttatgtgaacagagtatgctgtatgcagatttggtgggcaaagctacaaaatgaaatctactcaaggggctcatataatcatatggtcaatttcatgttggatcaacaaacattcaggagcccagtactatgtgccaggctctgaattagaactggtgagtaacaagaaaaataaagcaaagtccctgctatggaggaattcagtctaatggggaagatagacatccagggcaagaagtgctatgcttgaggtaagtgagggtgtttggaggcataggggagcttgcccttggctcagcctgcggctgatagggattgaagaaaccttctctggggagatgacatctgagctgagtaggagtaagccaaaccaaagaaatgtggaaagagcgataggtggagaaggatgacatgagcagaggcatgcaggcacgcaatgactagacaggtatggggaactaagagcaggctgccgttattagagaggaaagtatcaggaggaggtgggcaagaggctggaggcgcaggcatggccacaggagggagagagaactgggtctcctgtgctgaggagtacaggctttatcctgagggggtgccactgaaggatttcaagcaggggagtaatagggttggatttacatcttgactaaactatctgtcaatttggaagaaatcattcaaattgcccatgggatgaactgattcaagaattccattgaaagggtaaatttgcagatgtagccatagttaagtgcaagtatttctttttccaaggtggtttgttataaggctttcttagggatgtcgctaaaacaacacagagacagataagtggatctatctgtaaaggtcaacatctttgaaaaggatgcaggtcctctaaacagtgcttaaaggaaacagggcttgcagagagtcttgtggcttctaccctttattccgtgctgcagtatcaggttaggaatgcaaattgtgctatcatctttttgttttgtttagcaaaagtcatccgggaaggcattgtttaacctgagttgcagccatctaaatcttgctgaaaaggaatattttggattagaattctgcagccattctggaaataatgtaagttggtttcattatagggttctttgtgtctagcattgcttctaaatgcagtttgcagctaggtatgtagggttcaattccctgattgaaaaatgaaaaactatgtgcacccttgcaacatgattagatttaataactagtttttgtcctccctctttgtttattaacagtcaccttggccaggtgcggtggctcatgcctgtaatcccaacactttgggaagccaaggcaggtggatcacctgaggtcaggagttcaagaccagcctggccaacatagtgaaacctcatctttactaaaaatacaaaaattagctgggtgtggtggtgtgtgcctgtaatcccagctacttgggaggctgaggcaggagaattgcttgaacctgggaggcagaggttgctgtgagccagcatcgcaccaccgcatcccagcctgagcaacagagtgagactctgtttcaaaacaacaagtcacctcaatttgccaaacacaaactcttttaccccacattcctgttttgtcactctgtgagcagctatgcatgctttatcaattttgcctttccagagcctggacctcaacctgcagaattaagacttttaacctcaccagtgaatattcagaggaatctcctttctcctttctcagaccctaacgttcagatattcttctgttgtgtcctgccttggcatatctgtgatctggcatcttcccagaaaggctcattatgtctattagactggcatttggggactggagggttcaaatgtggagccaaatgccttcattagtctttgtagcaactaatgagccatgtatgtgacacctctgtcatcctactaaggcagtggagcagtgattcaaatgtcaacaagaaagagtttatagatcaacaatgttcactgtcatcgggaaaatataagggggcagattaaacgtagtatgccacctatttgacattgctgtttgtttctacctttagaagtctaaatagtcctggtactcatttatttcatgttaatctttatctattaccgaaaaaaaaaaagctctgctcaatgccatgctctaccaattttttccttaatgttattacaggtttggctggagcttttgaagcccataacaaagcaggtaaaaagtaagtatggaaaatcatttaaggaagagagttcacagttagagcttgagaaaggtttcaacaacctcacacaatttctcattttaatataaggggagaaaagggctttgagatattatttcaacccttcatacatccagtaaattcagcaatttagaaaattgttttaattttgcctgagatgaaagaaatcatgctgctggatctttgagtaaatctgaagaactctggtaattacagtactctggattggtttgaggaatatatctcattttctggcactgcaaatcttcgagcatccttgatgtcaatctgcaatgccattcactgtctgcctgaagattctttagttatatcctgtcacaagcattattcactcgctttagttcatatttaagtgcctaatatgtatgaaatattttctccctatattttacaatctagtgtgatggttctcaaatttcagtgtgcattaggatcgcctgagtttcttgttaaatgccgattcctgggccttattcctgagttgccaataacctgcatgtttacaaaattccacagatgtttctgaggcaggcggagttgtatcaggactttgcactgttttaatgtctcttttactggttcctcttcctctacctgctctttacatgttagtgcttcccaaagttctgtctgttcccactgcataaggatcacctgtcacattattccaacagcttccaaattgattcccctcatccatcatctacattactcccaaagaaatctattgaaaacaaaattccacagatgtttctgaggcaggcggatttctatcaggactttgcactgttcctcttcctctacctgctctttacatgttagtgcttcccaaagttctgtctgttcccactgcataaggatcacctgtcacattattccaacagcttccaaattgattcccctcatccatcatctacattactcccaaagaaatctactgaaaacaccaacctgatcacatcactcttcttcttaaaatgctttcctggctccctactacctacccttcgaggaataaagtcccaattccttaggatggtacacaaagcattgaactctggctaccttcctagccttgtccttgctactagctacctcgtattcctacctctgctgactttgacaaaactaatctcagatggaggcttagcagataaaatacagaatgccctattaaattgtaattttagataaacaaagaataattttcttatataagcacatctcatgcaattgttgtttatctgaaattcaaattgaactgggaatcctgtgcttcttattcactaaatctggccactctactcaggtctcaagtcctctggtaggacatccttgacctcctccaaactctttcctcccttctgtgcttccccagtactcagtgcttatagcattttagagtgttataactgtctagatgtctgtctcttctactagacagtgagctcttagttgtctttttactcccaatacctgctttgcagataatgggcaccaacaaatatttactgaatcaatggtgttaatgctgcatgtgtgcatttatgttttgtgtaaaagttaattttcaaatgcaagcaggtgtgaagataagtatatgtgttttcttaatgtataagatagaggtatcagtccatcatgctttgaattctctttatgagatacttaggcttggtaatgtacacctgcctcagctgaagttgagcccttctctcagtcaggaatgcagaatcccaactagcaagtgctgtatttttctgaatgggatacttaggagaggacacagtaggcctcaaaggggcacatttatacaaataaactcgaaggcagagagggtagaaagaggggtgggagaactttcccaatcgctatatacatagagacacaatccagaaattgtgacactttatacatgtgataaatggaaacacagaagtctgtaggagggagtgatggggaggggacggaagaggagagcggtgtgtgtgtgggtgtgtgtgtgtgtgtgtgtgtgtgtacctataactgttgtgatggacatttaaataaaacttatggagatattgtgttttaagatcctaaggagattgttttcaaatttatggtgaaatttttcccagtggaccctggacatctgcgggaagaacttacaaggtatagtgattacctgtgtgtctctgcatgatgttacttaagaatcattattctccatttattgggggcaagtgcttctggccattctcacaaaacttggctttaagtcactgtctgggagatggtgaggatctggagagaggatgggcctagctggttccccaggtgttcatcatccaaagggtggagactacaggaagaaagaggtgtgttctagaagttcaagcctgggtatccacttgggggttatgccattaactactacaacaatgaatgtgctctccttcatgaatctgtgtttcagtcagagagggcagcttaacagcacgggtataataccagccgatttccatggaaattgaaaatgtgggggttgtgaatgtatctcacagaagacaaaataatctgtaatgatgataaatacttatgaaaaaatgtccttcagaattacaaagtaaacctatttctgcaaaaatatgttgtcaacaaaacattcctcaaaaccttactctactttctagacttacacttttttttttttttttttttgagacagggtcttgctctgcctcaggttggataggctgaagtgcagtggcaacctccctggctcaagcaaccctcccacctcagtccttgtgccctgcttcccgccaaggactacaggaacttgccgccacgcccggctaatttttaaggttttttttttttttttagagatggggctttgctatgttgcccagactggtcttgagctcctgagctcaaatgattctccgccttggcctcccaaagtgctgggattacaggcatgagccaccacacctggcttagatttagactcctatacgtgaaagaggtctgagagataatctaatcgagccctcttagtttacagaggaagagataggtcatgggagctaaaatgactgtccaagatcacagaaggttgccagttattctccctgatgtcttccccccaaaagagttcatggccagttcaatctttgccccttttataaagacttttctgagtggcctttgcaaaagtcgctttttacaagcctctctttctgtctttctctctcctaattctctctccacatttgtgagctacaggccactttcccaaataacttgataccttggtatatatatgtatttgcgtttgctaacccatttcagttgagttttaaattgtgaccaattttgatggagataaactccccccacctccaaaaaaaaaagaatgggaaaatcaatgtgatgataaatgattcatcagctgttcagagcaaggatttggtatttgtagcaggcagctgccttcttaacagcaaggaacgtgtcaaatgacaagaagttccctttctttcatgctaggagcaaaacgaaattcacctttcctttagcaactaaagctgattattctcattgacaactatatttgaaaacaggcaatgacaaaggttaggcttcatttatttgtttcccattggtccatttaaataatacttaactttagttgagtctacaaggatgccttgtctaggctaatacatgggtttctaagagtggtgtgcaaatgtaatttttctaattgaatcgtttctaatgtataaggagagctcataatttgaaagattataatgatgaatgcttttgtaaactgaataatcacctgctaatttacttgctttttcaatctagattttcacatatcacttgcgattaattttgattcaccacattgccttcaaggcttaattggttttaaaaaaagtacacatagacctttatttagaaaatcacatttttatagggaaatgctcatagtactcagtgttttaatttataaaacaaaatattggggccagacacagtagctcacacctgtaatcctagcactttgagaggccaaggtggggcaatcaactgaggtcaggagttgaagaccagcctggccaacatggtgaaacctcgtatctactaaaaatacaaaaattagctgggcatggtggtgcatgcctgtagtcccagctgctaggaaggctgaggcaggaggatcgcttgaaccccagaggcagaggttgcagtgagctgagactgcaccactgcactctagcctgggtaacagagtgagactctatctcaataaataaataaataaataaataaataaataaataaataaataaataaataaaatattggaaccaatcttggaccatggaagaaggtaattagtggtaggtagtcttcattatgcacatttctttacaaaatttgattctcctttgaaaatgactttttcataagtgtgggataaatgttatctgtttagcagagccctagataccaagctgcatttcataggtccctgatgagcatttggtgggaaaaggggcagtttggtttagttcttttcagcaaacattaattacactaactgtgtaaaatgatgtgttgggcactggtgatacagagaagatggtccaggccaagggaataacaggcagaagcagggccccaagttcttcatttctaaaacacagtcttttggataggaggcagcctgaattcaggggcagacctaagttctagccacagattcactatccttgggtgatatgaccttgtcaaaatcacctagcccctctctttctataactgtaaactggagtgatcatttcttgctccaccaacctcctaagttgttatggtagtgagtacttgatagtgttttgtaaacagtatgctactggcctcctgagtgcatttattcttgcttgatctcctattctttctagctgggaatgtggctttgctacgtggcagaaaccaccagaggatgattggccaactttctcaatttggcaggaggatttggccagggtgattcctaatggctgtgaggcctgccaaagtgttcaatcagctgagttgtggtccgggtctggtttggggctgaagcaaagcctatgcattactcaccacccccaaaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatgtaagtagcaaatgtctgtctgctttgggacctatcagccaggtagagaaccaagcacaggagctgagctccccacacatgcccatcactgtgttagggtttacaggggagagaaagcctggataagatagagagaaacagcatggcctgagcctgagtttccttgtctttaaaatagtgacaagaatacctttggttctgtggattaaatgtaaatgctgattttcttctaccccagtccagccttcccctcctaccgcctctgggaaagctgtccaggaactggtttgggctaatttgggcatgggctttgccagacaggtccccactccctctgcttaccccaggataattctctgatacatgctctctgtagcacattgtcacgtttgttgtgatttctctgttgctctttatcatgatttcagagaacaaagcacagagtacagcaggtggagagaggttaaaagggaaaaaagccccaggcatctattagcgttccccatatcctaacaaccaacaagtagctggactaggctgcataacgaaggtaggtagaaggtggtctggggaacagcaggggccttccagggagggggtgatgcctggcaggccaggctgctgctacagccccaagggcagggtataggcagctggagatagtatctcttctaaagccagctggacattttctcccttctagagaggcctccaaagaataggctgtttcttaccagtcctgcaggatcataacttcattttttgtatcttaagttcatttttgacctctgtaccttacctttctgatagtccagaaatgacagatttctaatttcaccgggagccccagaatgcagtgcttagatagggacagtgtctgaataagtgtttaccaagtgactcctggcagggacaatcaatgagagccctaggatctcagaaaggcagagggcagtaagagaaatggtaatcatggaaggctgttggagaaggtggcttttgtgctgggccttaaagggacacataggaattggataagtacttgtcagtaaaggaaacagcatgaaaacaaaaatggtggttagacaagaagtgacgtatatagaggatgaaaaatgacccagtatagcccaaacatagggcctgtttagaagaggtgatggaaaatgcaccattttgaagggtcttgaatgccgaggacactaaccgtcatgtccagtattgtactttggcactggggtgggagcatagggtagagcagatagaggaaacagtgctagaagacatccttctccactagctgcctgttgaggcagcagtcagaggattggggctcccaggcagtctctgacgggggagctcaatttcattcttaacagttctgccttatggatttgagcattccctagtggccgtttcaggcatagcacagagcacttgagcttttctagaggatattgtctgtcagtagaaactctttccatggaaaaaagctaaagttccaactaggtagttcttcgcaattgattgcagtgagactatttcactaaactctaacgtagtatgcagaacacaactagattgctctagttgtgcaatttatttgtctaattttccattcatctaatatttgttggatacctgctatattttaagcgttcaagaacctccacatttatttgtctaattttccattcatctaatatttgttggatacctgctatattttaagcgttcaagaacctccacattccaaccttctcgtctcctttgtttacacttacacacctctctattctagccagacactccctcccaaacacaagctgaacatttcaaatgaagtgtccctcttttatgaactccctcagtaactcttcttggtcgttaattcaagaaaattgtatcatgtacctaccacatgccagatactattataggcactgggaacacagcaataaacagacaaaaatccttgcccttgtggagctcacattttggcagcgggggaaaatcagacaatgaccaaaataagtaaataaattatataatgcatggtagcaggtgataagagcaatggagaaaaatgaagcgtaggagggagatggaagaattctgggggcagatactgaatatttatatttttaaattttattcttttcttcttttatggacaagagttaacatcggcataaatattattttttgagatggggtctcacgctatcagccaggctggagtgcagtggggcgatctcagctcactgcaacctccacctcccaggttcaagtgattctcctgcctcaacctcctgagtagctgggattacaggcacatgccaccacacccggcttttttttttttttttttgtatttttagttagagacagggtttcaccatgttggccaggctggtcttgaactcctggcctcaagtgatcctcccgctttggcttcccaaagtgctgggattacacgcgtaagccacagtgcccagccagcataaatatttaaataaggtggacagggtaggcttactgggaagatgacagctaaacaaagacttgaaggaggtgggagggtaagctatgcaacaaaatcatgtgaaagagaatcctggcaaagagagcatgcagtgcaaagggcctgaggtgagagcatgcctggggtgttcaagaaacatcagaaaggcttttatggctggctggagctcagtaagagaggaagagaataaatatgaaggtcttaaaagcatattaaagggccaggtgtgttggttcatgcctgtaatcccagcactttgggagactgaggtgggaggatcgcttgaggccaggagtgcatatccgactggccatctcttttttaaaaaagcatatgaaagacctatagcataactctaaatgagcagataagccatcgaagcagtttaagcagaggagtgaaataatctgaattaggttttgacggggtccttttggctgctgtggtgaaaacagacctcaagaggaaatggtggaagtggggagactagataaaaggatattacaggagagagagaccatggtagtttggaccagcgtggtaacagtgaaggtgcttataacatttgtcaccttctgttactggagctatttactcattcgtatgtcatagttgtattcttaggttgctatagtcttgtatggagagaaaaaaaagcacagtcttatgtgcttttgtttttcttagggtcaacgtgggatttgtggttaataaactggaaaattggggtgtgtgtgtttgtgcatgtgatttatttaaaaaaacagctctattgaggtataatttacacatcataaaattcacccattttaaatgcacaactcaatgatttttagcaaatttacagagttgtgcaagcattaccgcaatccagttttaaaacatttccatcacaccaaaagacatctctcatccctacttgcagtcacgccctgttcccacgctcagccccaagcaaccactaatttgctttctgtttctgtagatttgcctttcctgaacatttcatgtaaatgaaatgataaaatatggggtattttgcatctgacttttttcactcaaaataatgatttttaaattaaagcatgctctaacatgagctgcaacagtttgttcctttcttttgctgagcagtattccatttatggatttaccacttttttttttgagatgctcactgcagcctccacctcccgggttcaagcaattctcctgcctcagcctcctgagtagctgggattacaggcaggcaccaccacgcccggctaatttttgtatttttagtagagacagggtttcaccatgttggtcaggctggtctcgaactcctgacctcatgatccacccactttggcctcccaaagtgcttgggattacaggagtgagccactgcgcccagccacattttgtttatctattcacctggtcgtggacatttggattttcttccagtttagctattatgaataatgctataagcattggcacacaagtgttcttgtggatacaagtcttcatttcttttgggtacattccaaggagtgtaattgctaggtcttatgatatatttatattgaacattttcagaaactgccaattcaaattgttacaataacattagaaatgtacaaggtttttgacttcttcataccttcactaacacttggtattgtatatctttttgattatgaccattctaatgggtataaagtatctcactgcaattttaattagcattttcctaatgactaacgatgttgagcacagtttcatgtgcttattccaatgttttctttggtaaaatgcctagtcaaatcttttgcccatttttaaatgagtttttatattattattgagttttaagagggttttataaattctgattaaaagtctttataagatatacaatttgcaattttctcttctaatctgtggcttgtcttttcattttgtaaggatatcttttgaagtacaacagttttaaaatttgatggaatttcactttctgtgtagttttagtggatcattctttcggtgttgtatctaagaactctttgcctaacttaaggtcaaaaagattttctcctagaacttttataaatttacctcttatagttagatctatgatccattttgagctatttttttgtacgcttgcatggagtatagtgtgaggtaggggtccgacttcatatttttgtgtgtggatgtccatttgtcctagcaacatttgttgaaaagaatattatttttcttcattgaattgtcttggcacatttgtcaaaaaccaattgaccataaatgtaaggagttacttctgtactctcacttatgttccattgatctatatttctattcttatgccattaccacactgtcttaattactgtagctttgaggtaagctttgaaataaggaagtgtacacattgcccaactttgttctttttcaaaatagtttggttattctgagatctgtgcatttccatgtaaattttaaggtcatttgtcaatttctatttttaaaagcctactgggattttgatggggattgcattgaatttatagattattttttgaaaaaattgccaccataacaatattgaatcttcttgtctgtgaacatgaactatctcttcatttatatagatcttttaaaaatttcccttggcagcattttgtacttttcagtgtgtaagccttacacttcttttattaaattcattcctctgtattttattcttttttgatgctattgtaaatggaactttttaaaatatcatttttagattattcattgctagtatatataaatacaattgctttttatatattgatcttctatcatgctaccttgctgaactcatttattagttctagtagtttttcataggttccttgggattttttttctttcctttttttcctttttttttttttgagacagggcctcactcattcacccaacctggagtgcagtggcacggccatggctcactgtagccttgaattcctgggctcaagcaatgctcccacctcagcctccaaagtagctgggacctgggaccacaggcatgtgccaccacacccagctaatttttacattttttggtagagatggggtcttgccatgttgcccaagctggtctcgaactcctgggctcaagcaatcctcctgccttggcctccctgagtgctaggattacaggcgtgagccaccacgctcaaccttgggattttctacatgcaggatcatgttgagtgcaagtaaagacagttctaccaccttcttttcagtgcaaattctttatgtttcttcttcttgcctgactgcactgactagaaccatcagtacaatgttgaatagatgtggcaggcacttgatatctttacctgatttctgatcttaagtgaaagcatttagtttctcaccatttggtatattccttgtttgttaagtgttttgttttgttttgttgattgtgagtgggtattagactttgtgcaatgctttttctccatctcttgagaagataatgtgcgggttattttttttttgtcctttattctattatcatagtgtattatagtcattggttttcatatgtcaaactgaccttgcaatcctgagataaattcaactcattgtgtataatccttttcatatgctgctgaattcaggttactagtgttttgttcagaatttttgcctctgtattcatgaggaatgttgacctgtagtcttcatttcttatgatgtttttgtcccgttttggtatcagggtaatattgacctcatagaatatgttgctaagtatctactcctctattttctgggagagtttgtgaagaattggtatttatttcttctttgaatatttgatagaattagtcagtgaaaccatcagagccttattgggtttcaatgtgatttgtacatttatcagtattggcaaaaaaaattaatcaatgagccatttctttggtcttttaaaaaatgtttattatatggagatttttattatattgtgatttttgaaatacagatatacacccacctgtctaaaacacaaatggaaaaccaagaaagaagagaaaaaaaacagccctccagcactcaaaataggtatcctattgtccatgtatcttatccaatagaagagcaccataggattccatggagagtctatttactcttacagtatatagaatgctaacaggtttggatatttgctttctcattttatgttagactagaagtctcactttagaaccaagtattctaaagtttgacttcaggggaagtcagtgaccaggaaatgattcatataaatctgacagagaggaaaaaggcatacaaattataaagaagaaaaaagaatccaaaaatcaaaacaatctgaggcaattaaggttaagggcacatagtcctaaatgcctttgtagacatagtgctgtaatagatgtttcataaaaataaactggaggcatctagaaaagagcaaattatgatcatagataaactgctagctatttggaaaagccagaatgattttcaggatgattcatctattggggatttcagatagctggggatttactagactcccaatgtacagagtgatgaattggcttgcaatgtcgttggcatttatattcctctttcttgataatatatgatcaggatggagtggggttggatggctgtactagtttgctagggctgccataacaaaataccagagactgaatggcttaaatgccagaaatgtatgttccacaattctggaggcttcgtgtccaagataagctgtcagcagttgtttttttttttttcctgaggcctttctccttggctagcagatggctgccttcttgttgtgttatcacttggtctttttttctgtgtactcacatccctggtgtctctctgtgtgtccaaatttcttcttcttataaggataccagtcagattggtttaaggcttgccttgatggagtcatttcacctcaatcacctcctaaaagctctatctccaaatatagtcacattctctgctactggaattaggactccaacatatgaacttggcagagggtggggacatagttccacctataccagtggctgattgaaagtaagagagatcatatatacaatatggtagaagaaaaatctaacaaaatgttcaactgtgatcttggagcccctaagatctatatttggtctgtgactttctatactaaggctgaaatgcttccaaattgaaaaagagccaattgccccccccaaacacacacacccctatagaaacataaatatacataaagcgtggggttggaggctttggactgcattggctacaaagaaggggctgtttgatggaggacaagggtatgctggatgctccattgctaagttcctcaaaggtaatgtgaaaaatgtctttttcctgtcatgcagcagaacttggagactttcatgaagaaacagataggaagcatctggcacaaactcggtacttaccaaaccaagactgtttagagggcaagatcatgcactttcatcagaagcacatgtaagtactttcagctggcacctgcttcccccagtagagaacactaaaattggggacagactcttaagagcaagcccttaaacctgagaagtttcaggctccatgaaacgctgagatcctcatggagctctcagggtggaaatgtcattcttgaggcatttattaggctcataaattctttcccctttcagtggcaggagcccagctgaatctgacattctgctactggacatagcaaggaagctggatatgtatggcatcaggcctcaccccgccagtgatggtgaagggatgcagattcacctggctgttgctcacatgggagtactggtgttacgggtaaaatctctttcctttcaagcccttcagctttagtgaggggtggttatcttggctcaaacttgggtgtcctttcccaaggtgatctcacccctcagtattatcaccagccagaaagggaaatggtcaatcatatttacttgtagttgcatgaaaagtatacatgacaaactaataaacatagttaactgcagggaatggatagatggggacagaaataggggtgacagtggtgggagtgagacttctttctatatatatctttttgtatacctctgattttcagaccacgcgaatagattacctgttgaacaaacaacaaataagcaaaaaagcaaagctggttggaccgaccaggaaagccaagggagtttagaggagttggaaatgggtgtaggctgcagtaattaaacagaatagcctagagaagggtctgtcagagctggcaagaaggcttgactatgtggaaggcattgtgggcaaggaaaatgaggagactgcaggagagaggtatagagttagatgaaagggtgttttggaattagtgggaacaaaggttatatattcaatatagatgaggcagcaagatatggccatgatgtgatgtgggcagtgaggagctattgaaggtgtttgagctattggggtgtcaggagaaagaggacattgtttttagcagatgaatcgggaaacatgggaaaggggcgagattagaaaagctattgtagtaatcctttcctcttgtgatctccctgtgctggccagaaaacttccctaggcataccccttcttgcttgcattccagagcatccttgtatcccacctgaaatgccttctttgaccacagctcctacccagtgcagcaggatcaatctgtgcaagagatgggtcaagggcggtccctctcattaagtgcattttctatcaggtttgcactgtcttacaagccaactcttgttaatacattctgaaatctgccacatttttcattgtagggaaatacaaagatcaatacttttaactgggctaaaatccgcaagttgagttttaagagaaagcattttctcatcaaacttcatgccaatatcttggtaagtagctttctaataaattcgtttactttctgttcactgggaatttttttggttgtttctgcaaatcgtttgaatgtaaattgtaaaagccggctggccctgagtgatggtgtgtcttttcttttgcctttgaagaaatcaaccagagttttaatcattttttactaaaggcaaaacactaagaaatctgattggcagtttagagttaacaaagtaataggaaaatggggcagctcggctgaaaggcaagtctccctggaaactgctttttagggatttgataagtcaaatgggagtgaccagatctaggactaagaatacattcatatgatgttatctgttccattttataaagtatcttcaattactttccttaagcaaaaattattgaacacctagtatatgccaaaaacaagcaggatgtgggagtcaggtatacacgtaagcaaaataaacagtttttgggcaaggttgcatagtaaagggtgagacaaaggtgctagaaatgatcttctttttttattctagagatagggtcacactgttgcccacactgaagtggagtggtgacatgtagctcagagcagcctcaacgtcctgggctcaagtgatcctaccgcctcagccttttgagtagctaggactacaggcatgtgccaccacacttcgctaatttttaaaacatattttgtagagacaaggtctcactatgttgcccaggctggtctcaaactcctggcctcaaatgatcctcttactctggcctcccaaagtgctgacgttaccaggcatgagccacttagtctagaaaggaattttcttatgaccataaagaaaataaaaagtgtgtatcaactaatttttgacctactgaagatccagcagtttggattttattctctgcatcttgaccttatagaaaagtgttcattgagcagttcaagaaactggacttagtgtgaagctcatggagagccccagaggctacatgcaggaacctggaaaggaatgagagaagtggggtcagtgcagtgggttgatggggctgctgaaaacagggctgcaaacatgccatgtgaggggtacatatagtgtcaggagatggggaaaactcgaactttaggtctggaaagccaagattagaatatgctagatgagcaatatagagcattgtacaagacaacctatagaggaaaaagtgtttctaactgttacactaaaaagactcatggactgagtgtagtggcttgcgttcataatcccagtgctttaagaggttgaggtggaaggatcacttgagttcaggagtttgagaccaacctgggcaacatagcaagatcccatctcaacaaaaaaaactacaaagaaattaagcgggtatggtggcacatgcctgtagttctagctattcaggaggctgagtcaggaagactgcttgagcccaggagtttgaggttatagtgagtgatgatcatgccactgcacttcagcctgggcaacagagtgacaccttgtctcaagaaaacaacagacttatgtacatgtaatcatcttataaacccttccatctataaggaaatcttctcctccctcctgtttcctgttggtcatttataacttctcaccttgaaaagatgccctttgacatgattttaatctaatttacttcataaaaatgtttctggcagagaagagtgagtaaaaaaggtatttaaggtgaggggagtgtgcaaagcaatatttgcttcttagagaaggctctgtttgtgagcagtggccctgtctattcctcgcaaggttgccaatcattaggtttcagcaggtgtgaaacctacagggagccaagtggaaaatcagaagctgcatgggccaacggagcaatagtttggaaggcattgggatttgaaggtctttgatattcttgaaggatgttttacttaatggaaattggtttatacaggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctataggtaattaaacaatgcacataggcaaactgctcacactgcttcttttcaataacacaggaggcttaggaggagttcacattctagaagcaacaaagaatccatttcaatcacatcaaagattgcaccctttcctgctcattctctgtatgacacattaagtcaatgttttctaactaggagggaggaagatgggggcaccttacctaaggggtaggatcagagtctcagcaaggatgggcggatgtgtgcagtttgagaatacatgttctataaacccattgtttctcctatatttaacttatatgcaaaccatggaaagaaaaagctcaacagcatcctttgggttgtaaaagctagcatgagaaagcactggaggggataagagatttagaagattgaacaatatgccactagagaatcctcactacaggtcacactttggaggaattgaagcaaggttgggttaagatcttgtctttcgagttaatggttgcagcacaccaacatggtacatgcatacatatgtaacaaacctgcacgttgtgcacatgtaccctaaaacttaaagtataataataataaaataaaaaaaaagatcttgtctttacttgaatacgtcagcctaggaatccgttggaggaagttttcaaaacttttagctaggtacaaaattctgattaaaagcttccccatacaggattttttccaaagagtgatatcctaccccagtaaaaattaagatctgttaaaacttacatatttctgattgaatctttccagtctgtattctatgaatccctgccttcttaaatagatgatactgagcatattttgcccctttcttaatgacctgagttattataaacatcacatatgatcttttgcaggcagctgtagtgcaataatggcctcagggcaggggatgcatgtcaaggccctgtacttaggtgataaatcatccagactctttagactttattattcttgtgtttttttttgttgttgttgtttgttttgttttgttttgttttgagatggagtcttgctctgtcacccaggctggagtgcagtggcgcgatctcggctcactgcaatctccgcctcccatgttcaagcaattctctgccttagcctcccaagtagctggaattacaggcgcgggccaccacacccggctaatttttgtatttttggtagagacggggtttcaccatcttggccaggctgatcttggacccctgaccttgtaatccaccagccttggcctcccaaagtgctcgaattacaggtgtgagccatggtgcctggctaattcttgtgattttttttgatttttatgtttctcccggctgtgatctgactttctttgttagtgtatgcctaactagaacaatcctcttctactgttcatttagctgcttttcttctgctgtggactgggaaaccagataagtaacctcattgaaagtagtatggaaaatcagtcagttgactctgatttggaggtagaggaaaagcctttaaagggaaatatattgttattattatttgagacagggtctcgctgtgttgcccaggctggagtgcagtgacatgatctccgctcactgcagccttgcctcccaggctcaagcaatcctcccacctcagcctcccaagtggtagggactacaggcatgcactaccatggccgggtaatttttattatttttgtagagatgaggtctcactatgttgcccaggctggtctcaaactcctgggctcgagtcatcctcctgcctcagcctcccaaagggctgggattaaggtgtgagccaccatgcccagaccaggtatattatttttaaagcccacaatttttagctgttatgtaaccctgttcagaggcctttaaaaattacctgcgttctgagtagttgaggttgttctctgcctggtccttgaataagtgggtattatcattgtgatggtcaaagattcatgacatatgtcattcatctagtcttttgatttcaacaataaacgaggctttcaagttttagtagcctattggtttatggctagaactaaggatttttattgttccttatgatagtggacgaacccaaaggcaacttttggaatatgggagaaaagggaggctgaagagcttgccatttgaaaggtacatgattttgtttctcttgctcgtgttgattttatgttgaatttggagatttctatgtatcctggtattcacatgaaggtcatttcaatgacttctctgcttggggatttcaggaaacattacccatctcagtaccatgaacgacagtgcaggtcctcaccagacctcctctctgatgtgtcaaaacaagtaaggtttctgaaaatttctacttctttagataaatgtaatttgtgcaaatttcaaatgcttccatgaattgattctgccagaatcccagtgtgtaaaaaggttactctgtttgagtaggttagcttcctggggaggtctgtcagctcagtctttcctgccaatagaagatcatttagtaaactaccactggtgtgtaccttatagactggagagaactggcacatcttcaaattgcaacctgtgttgctaacatcttgcaaaatgcagatccaaatggctttgaattttcaaaactgaaagctccatctttttacctatgaaaatcttaaagtgtagaggaaggtataaggtcttgggttaaagttttagagtatttttcctgtgtaattttgtaacttaaggacaaagtgttgttcccttggaactgtgagatgatggcttcctttgacatttttagtatgaaaattgtgaattatttttcttttactctccctaaaaaaataattataggtctcataaaccctcatgccttcaagtcactggcagtttttatccaaaaggcatcagaggcataatgatgaaaggagccatttagtatatgaacctctcataccattcatagccctcctcccaccattttacagaaaatagggaggaagctggagcagcaaggttaggagacttgtctaaggtcacacagcaaatcagagacagagccaggactaacaggcaggactcctggttcactaatatagctattaaaccaaactgcttgtagtgtatacactcagagtctggaagtaggatggcattgagaaagaatagtgtcacatgtactttttaacacatgcactgtgatgtagtagaagttattaccctttctttatatatttatctaccctagaatagaacatggatcttgttaaatgactttatgaaaaactacctttcaaactttgaggctaatttagatccctcccccagccctaaccaaatggccttttccttctttcaccaatgtgtccattctctcaaggtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaatta

SEQ ID NO: 3708 - DNA, 17270 bp, human
aaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatgtaagtagcaaatgtctgtctgctttgggacctatcagccaggtagagaaccaagcacaggagctgagctccccacacatgcccatcactgtgttagggtttacaggggagagaaagcctggataagatagagagaaacagcatggcctgagcctgagtttccttgtctttaaaatagtgacaagaatacctttggttctgtggattaaatgtaaatgctgattttcttctaccccagtccagccttcccctcctaccgcctctgggaaagctgtccaggaactggtttgggctaatttgggcatgggctttgccagacaggtccccactccctctgcttaccccaggataattctctgatacatgctctctgtagcacattgtcacgtttgttgtgatttctctgttgctctttatcatgatttcagagaacaaagcacagagtacagcaggtggagagaggttaaaagggaaaaaagccccaggcatctattagcgttccccatatcctaacaaccaacaagtagctggactaggctgcataacgaaggtaggtagaaggtggtctggggaacagcaggggccttccagggagggggtgatgcctggcaggccaggctgctgctacagccccaagggcagggtataggcagctggagatagtatctcttctaaagccagctggacattttctcccttctagagaggcctccaaagaataggctgtttcttaccagtcctgcaggatcataacttcattttttgtatcttaagttcatttttgacctctgtaccttacctttctgatagtccagaaatgacagatttctaatttcaccgggagccccagaatgcagtgcttagatagggacagtgtctgaataagtgtttaccaagtgactcctggcagggacaatcaatgagagccctaggatctcagaaaggcagagggcagtaagagaaatggtaatcatggaaggctgttggagaaggtggcttttgtgctgggccttaaagggacacataggaattggataagtacttgtcagtaaaggaaacagcatgaaaacaaaaatggtggttagacaagaagtgacgtatatagaggatgaaaaatgacccagtatagcccaaacatagggcctgtttagaagaggtgatggaaaatgcaccattttgaagggtcttgaatgccgaggacactaaccgtcatgtccagtattgtactttggcactggggtgggagcatagggtagagcagatagaggaaacagtgctagaagacatccttctccactagctgcctgttgaggcagcagtcagaggattggggctcccaggcagtctctgacgggggagctcaatttcattcttaacagttctgccttatggatttgagcattccctagtggccgtttcaggcatagcacagagcacttgagcttttctagaggatattgtctgtcagtagaaactctttccatggaaaaaagctaaagttccaactaggtagttcttcgcaattgattgcagtgagactatttcactaaactctaacgtagtatgcagaacacaactagattgctctagttgtgcaatttatttgtctaattttccattcatctaatatttgttggatacctgctatattttaagcgttcaagaacctccacatttatttgtctaattttccattcatctaatatttgttggatacctgctatattttaagcgttcaagaacctccacattccaaccttctcgtctcctttgtttacacttacacacctctctattctagccagacactccctcccaaacacaagctgaacatttcaaatgaagtgtccctcttttatgaactccctcagtaactcttcttggtcgttaattcaagaaaattgtatcatgtacctaccacatgccagatactattataggcactgggaacacagcaataaacagacaaaaatccttgcccttgtggagctcacattttggcagcgggggaaaatcagacaatgaccaaaataagtaaataaattatataatgcatggtagcaggtgataagagcaatggagaaaaatgaagcgtaggagggagatggaagaattctgggggcagatactgaatatttatatttttaaattttattcttttcttcttttatggacaagagttaacatcggcataaatattattttttgagatggggtctcacgctatcagccaggctggagtgcagtggggcgatctcagctcactgcaacctccacctcccaggttcaagtgattctcctgcctcaacctcctgagtagctgggattacaggcacatgccaccacacccggcttttttttttttttttttgtatttttagttagagacagggtttcaccatgttggccaggctggtcttgaactcctggcctcaagtgatcctcccgctttggcttcccaaagtgctgggattacacgcgtaagccacagtgcccagccagcataaatatttaaataaggtggacagggtaggcttactgggaagatgacagctaaacaaagacttgaaggaggtgggagggtaagctatgcaacaaaatcatgtgaaagagaatcctggcaaagagagcatgcagtgcaaagggcctgaggtgagagcatgcctggggtgttcaagaaacatcagaaaggcttttatggctggctggagctcagtaagagaggaagagaataaatatgaaggtcttaaaagcatattaaagggccaggtgtgttggttcatgcctgtaatcccagcactttgggagactgaggtgggaggatcgcttgaggccaggagtgcatatccgactggccatctcttttttaaaaaagcatatgaaagacctatagcataactctaaatgagcagataagccatcgaagcagtttaagcagaggagtgaaataatctgaattaggttttgacggggtccttttggctgctgtggtgaaaacagacctcaagaggaaatggtggaagtggggagactagataaaaggatattacaggagagagagaccatggtagtttggaccagcgtggtaacagtgaaggtgcttataacatttgtcaccttctgttactggagctatttactcattcgtatgtcatagttgtattcttaggttgctatagtcttgtatggagagaaaaaaaagcacagtcttatgtgcttttgtttttcttagggtcaacgtgggatttgtggttaataaactggaaaattggggtgtgtgtgtttgtgcatgtgatttatttaaaaaaacagctctattgaggtataatttacacatcataaaattcacccattttaaatgcacaactcaatgatttttagcaaatttacagagttgtgcaagcattaccgcaatccagttttaaaacatttccatcacaccaaaagacatctctcatccctacttgcagtcacgccctgttcccacgctcagccccaagcaaccactaatttgctttctgtttctgtagatttgcctttcctgaacatttcatgtaaatgaaatgataaaatatggggtattttgcatctgacttttttcactcaaaataatgatttttaaattaaagcatgctctaacatgagctgcaacagtttgttcctttcttttgctgagcagtattccatttatggatttaccacttttttttttgagatgctcactgcagcctccacctcccgggttcaagcaattctcctgcctcagcctcctgagtagctgggattacaggcaggcaccaccacgcccggctaatttttgtatttttagtagagacagggtttcaccatgttggtcaggctggtctcgaactcctgacctcatgatccacccactttggcctcccaaagtgcttgggattacaggagtgagccactgcgcccagccacattttgtttatctattcacctggtcgtggacatttggattttcttccagtttagctattatgaataatgctataagcattggcacacaagtgttcttgtggatacaagtcttcatttcttttgggtacattccaaggagtgtaattgctaggtcttatgatatatttatattgaacattttcagaaactgccaattcaaattgttacaataacattagaaatgtacaaggtttttgacttcttcataccttcactaacacttggtattgtatatctttttgattatgaccattctaatgggtataaagtatctcactgcaattttaattagcattttcctaatgactaacgatgttgagcacagtttcatgtgcttattccaatgttttctttggtaaaatgcctagtcaaatcttttgcccatttttaaatgagtttttatattattattgagttttaagagggttttataaattctgattaaaagtctttataagatatacaatttgcaattttctcttctaatctgtggcttgtcttttcattttgtaaggatatcttttgaagtacaacagttttaaaatttgatggaatttcactttctgtgtagttttagtggatcattctttcggtgttgtatctaagaactctttgcctaacttaaggtcaaaaagattttctcctagaacttttataaatttacctcttatagttagatctatgatccattttgagctatttttttgtacgcttgcatggagtatagtgtgaggtaggggtccgacttcatatttttgtgtgtggatgtccatttgtcctagcaacatttgttgaaaagaatattatttttcttcattgaattgtcttggcacatttgtcaaaaaccaattgaccataaatgtaaggagttacttctgtactctcacttatgttccattgatctatatttctattcttatgccattaccacactgtcttaattactgtagctttgaggtaagctttgaaataaggaagtgtacacattgcccaactttgttctttttcaaaatagtttggttattctgagatctgtgcatttccatgtaaattttaaggtcatttgtcaatttctatttttaaaagcctactgggattttgatggggattgcattgaatttatagattattttttgaaaaaattgccaccataacaatattgaatcttcttgtctgtgaacatgaactatctcttcatttatatagatcttttaaaaatttcccttggcagcattttgtacttttcagtgtgtaagccttacacttcttttattaaattcattcctctgtattttattcttttttgatgctattgtaaatggaactttttaaaatatcatttttagattattcattgctagtatatataaatacaattgctttttatatattgatcttctatcatgctaccttgctgaactcatttattagttctagtagtttttcataggttccttgggattttttttctttcctttttttcctttttttttttttgagacagggcctcactcattcacccaacctggagtgcagtggcacggccatggctcactgtagccttgaattcctgggctcaagcaatgctcccacctcagcctccaaagtagctgggacctgggaccacaggcatgtgccaccacacccagctaatttttacattttttggtagagatggggtcttgccatgttgcccaagctggtctcgaactcctgggctcaagcaatcctcctgccttggcctccctgagtgctaggattacaggcgtgagccaccacgctcaaccttgggattttctacatgcaggatcatgttgagtgcaagtaaagacagttctaccaccttcttttcagtgcaaattctttatgtttcttcttcttgcctgactgcactgactagaaccatcagtacaatgttgaatagatgtggcaggcacttgatatctttacctgatttctgatcttaagtgaaagcatttagtttctcaccatttggtatattccttgtttgttaagtgttttgttttgttttgttgattgtgagtgggtattagactttgtgcaatgctttttctccatctcttgagaagataatgtgcgggttattttttttttgtcctttattctattatcatagtgtattatagtcattggttttcatatgtcaaactgaccttgcaatcctgagataaattcaactcattgtgtataatccttttcatatgctgctgaattcaggttactagtgttttgttcagaatttttgcctctgtattcatgaggaatgttgacctgtagtcttcatttcttatgatgtttttgtcccgttttggtatcagggtaatattgacctcatagaatatgttgctaagtatctactcctctattttctgggagagtttgtgaagaattggtatttatttcttctttgaatatttgatagaattagtcagtgaaaccatcagagccttattgggtttcaatgtgatttgtacatttatcagtattggcaaaaaaaattaatcaatgagccatttctttggtcttttaaaaaatgtttattatatggagatttttattatattgtgatttttgaaatacagatatacacccacctgtctaaaacacaaatggaaaaccaagaaagaagagaaaaaaaacagccctccagcactcaaaataggtatcctattgtccatgtatcttatccaatagaagagcaccataggattccatggagagtctatttactcttacagtatatagaatgctaacaggtttggatatttgctttctcattttatgttagactagaagtctcactttagaaccaagtattctaaagtttgacttcaggggaagtcagtgaccaggaaatgattcatataaatctgacagagaggaaaaaggcatacaaattataaagaagaaaaaagaatccaaaaatcaaaacaatctgaggcaattaaggttaagggcacatagtcctaaatgcctttgtagacatagtgctgtaatagatgtttcataaaaataaactggaggcatctagaaaagagcaaattatgatcatagataaactgctagctatttggaaaagccagaatgattttcaggatgattcatctattggggatttcagatagctggggatttactagactcccaatgtacagagtgatgaattggcttgcaatgtcgttggcatttatattcctctttcttgataatatatgatcaggatggagtggggttggatggctgtactagtttgctagggctgccataacaaaataccagagactgaatggcttaaatgccagaaatgtatgttccacaattctggaggcttcgtgtccaagataagctgtcagcagttgtttttttttttttcctgaggcctttctccttggctagcagatggctgccttcttgttgtgttatcacttggtctttttttctgtgtactcacatccctggtgtctctctgtgtgtccaaatttcttcttcttataaggataccagtcagattggtttaaggcttgccttgatggagtcatttcacctcaatcacctcctaaaagctctatctccaaatatagtcacattctctgctactggaattaggactccaacatatgaacttggcagagggtggggacatagttccacctataccagtggctgattgaaagtaagagagatcatatatacaatatggtagaagaaaaatctaacaaaatgttcaactgtgatcttggagcccctaagatctatatttggtctgtgactttctatactaaggctgaaatgcttccaaattgaaaaagagccaattgccccccccaaacacacacacccctatagaaacataaatatacataaagcgtggggttggaggctttggactgcattggctacaaagaaggggctgtttgatggaggacaagggtatgctggatgctccattgctaagttcctcaaaggtaatgtgaaaaatgtctttttcctgtcatgcagcagaacttggagactttcatgaagaaacagataggaagcatctggcacaaactcggtacttaccaaaccaagactgtttagagggcaagatcatgcactttcatcagaagcacatgtaagtactttcagctggcacctgcttcccccagtagagaacactaaaattggggacagactcttaagagcaagcccttaaacctgagaagtttcaggctccatgaaacgctgagatcctcatggagctctcagggtggaaatgtcattcttgaggcatttattaggctcataaattctttcccctttcagtggcaggagcccagctgaatctgacattctgctactggacatagcaaggaagctggatatgtatggcatcaggcctcaccccgccagtgatggtgaagggatgcagattcacctggctgttgctcacatgggagtactggtgttacgggtaaaatctctttcctttcaagcccttcagctttagtgaggggtggttatcttggctcaaacttgggtgtcctttcccaaggtgatctcacccctcagtattatcaccagccagaaagggaaatggtcaatcatatttacttgtagttgcatgaaaagtatacatgacaaactaataaacatagttaactgcagggaatggatagatggggacagaaataggggtgacagtggtgggagtgagacttctttctatatatatctttttgtatacctctgattttcagaccacgcgaatagattacctgttgaacaaacaacaaataagcaaaaaagcaaagctggttggaccgaccaggaaagccaagggagtttagaggagttggaaatgggtgtaggctgcagtaattaaacagaatagcctagagaagggtctgtcagagctggcaagaaggcttgactatgtggaaggcattgtgggcaaggaaaatgaggagactgcaggagagaggtatagagttagatgaaagggtgttttggaattagtgggaacaaaggttatatattcaatatagatgaggcagcaagatatggccatgatgtgatgtgggcagtgaggagctattgaaggtgtttgagctattggggtgtcaggagaaagaggacattgtttttagcagatgaatcgggaaacatgggaaaggggcgagattagaaaagctattgtagtaatcctttcctcttgtgatctccctgtgctggccagaaaacttccctaggcataccccttcttgcttgcattccagagcatccttgtatcccacctgaaatgccttctttgaccacagctcctacccagtgcagcaggatcaatctgtgcaagagatgggtcaagggcggtccctctcattaagtgcattttctatcaggtttgcactgtcttacaagccaactcttgttaatacattctgaaatctgccacatttttcattgtagggaaatacaaagatcaatacttttaactgggctaaaatccgcaagttgagttttaagagaaagcattttctcatcaaacttcatgccaatatcttggtaagtagctttctaataaattcgtttactttctgttcactgggaatttttttggttgtttctgcaaatcgtttgaatgtaaattgtaaaagccggctggccctgagtgatggtgtgtcttttcttttgcctttgaagaaatcaaccagagttttaatcattttttactaaaggcaaaacactaagaaatctgattggcagtttagagttaacaaagtaataggaaaatggggcagctcggctgaaaggcaagtctccctggaaactgctttttagggatttgataagtcaaatgggagtgaccagatctaggactaagaatacattcatatgatgttatctgttccattttataaagtatcttcaattactttccttaagcaaaaattattgaacacctagtatatgccaaaaacaagcaggatgtgggagtcaggtatacacgtaagcaaaataaacagtttttgggcaaggttgcatagtaaagggtgagacaaaggtgctagaaatgatcttctttttttattctagagatagggtcacactgttgcccacactgaagtggagtggtgacatgtagctcagagcagcctcaacgtcctgggctcaagtgatcctaccgcctcagccttttgagtagctaggactacaggcatgtgccaccacacttcgctaatttttaaaacatattttgtagagacaaggtctcactatgttgcccaggctggtctcaaactcctggcctcaaatgatcctcttactctggcctcccaaagtgctgacgttaccaggcatgagccacttagtctagaaaggaattttcttatgaccataaagaaaataaaaagtgtgtatcaactaatttttgacctactgaagatccagcagtttggattttattctctgcatcttgaccttatagaaaagtgttcattgagcagttcaagaaactggacttagtgtgaagctcatggagagccccagaggctacatgcaggaacctggaaaggaatgagagaagtggggtcagtgcagtgggttgatggggctgctgaaaacagggctgcaaacatgccatgtgaggggtacatatagtgtcaggagatggggaaaactcgaactttaggtctggaaagccaagattagaatatgctagatgagcaatatagagcattgtacaagacaacctatagaggaaaaagtgtttctaactgttacactaaaaagactcatggactgagtgtagtggcttgcgttcataatcccagtgctttaagaggttgaggtggaaggatcacttgagttcaggagtttgagaccaacctgggcaacatagcaagatcccatctcaacaaaaaaaactacaaagaaattaagcgggtatggtggcacatgcctgtagttctagctattcaggaggctgagtcaggaagactgcttgagcccaggagtttgaggttatagtgagtgatgatcatgccactgcacttcagcctgggcaacagagtgacaccttgtctcaagaaaacaacagacttatgtacatgtaatcatcttataaacccttccatctataaggaaatcttctcctccctcctgtttcctgttggtcatttataacttctcaccttgaaaagatgccctttgacatgattttaatctaatttacttcataaaaatgtttctggcagagaagagtgagtaaaaaaggtatttaaggtgaggggagtgtgcaaagcaatatttgcttcttagagaaggctctgtttgtgagcagtggccctgtctattcctcgcaaggttgccaatcattaggtttcagcaggtgtgaaacctacagggagccaagtggaaaatcagaagctgcatgggccaacggagcaatagtttggaaggcattgggatttgaaggtctttgatattcttgaaggatgttttacttaatggaaattggtttatacaggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctataggtaattaaacaatgcacataggcaaactgctcacactgcttcttttcaataacacaggaggcttaggaggagttcacattctagaagcaacaaagaatccatttcaatcacatcaaagattgcaccctttcctgctcattctctgtatgacacattaagtcaatgttttctaactaggagggaggaagatgggggcaccttacctaaggggtaggatcagagtctcagcaaggatgggcggatgtgtgcagtttgagaatacatgttctataaacccattgtttctcctatatttaacttatatgcaaaccatggaaagaaaaagctcaacagcatcctttgggttgtaaaagctagcatgagaaagcactggaggggataagagatttagaagattgaacaatatgccactagagaatcctcactacaggtcacactttggaggaattgaagcaaggttgggttaagatcttgtctttcgagttaatggttgcagcacaccaacatggtacatgcatacatatgtaacaaacctgcacgttgtgcacatgtaccctaaaacttaaagtataataataataaaataaaaaaaaagatcttgtctttacttgaatacgtcagcctaggaatccgttggaggaagttttcaaaacttttagctaggtacaaaattctgattaaaagcttccccatacaggattttttccaaagagtgatatcctaccccagtaaaaattaagatctgttaaaacttacatatttctgattgaatctttccagtctgtattctatgaatccctgccttcttaaatagatgatactgagcatattttgcccctttcttaatgacctgagttattataaacatcacatatgatcttttgcaggcagctgtagtgcaataatggcctcagggcaggggatgcatgtcaaggccctgtacttaggtgataaatcatccagactctttagactttattattcttgtgtttttttttgttgttgttgtttgttttgttttgttttgttttgagatggagtcttgctctgtcacccaggctggagtgcagtggcgcgatctcggctcactgcaatctccgcctcccatgttcaagcaattctctgccttagcctcccaagtagctggaattacaggcgcgggccaccacacccggctaatttttgtatttttggtagagacggggtttcaccatcttggccaggctgatcttggacccctgaccttgtaatccaccagccttggcctcccaaagtgctcgaattacaggtgtgagccatggtgcctggctaattcttgtgattttttttgatttttatgtttctcccggctgtgatctgactttctttgttagtgtatgcctaactagaacaatcctcttctactgttcatttagctgcttttcttctgctgtggactgggaaaccagataagtaacctcattgaaagtagtatggaaaatcagtcagttgactctgatttggaggtagaggaaaagcctttaaagggaaatatattgttattattatttgagacagggtctcgctgtgttgcccaggctggagtgcagtgacatgatctccgctcactgcagccttgcctcccaggctcaagcaatcctcccacctcagcctcccaagtggtagggactacaggcatgcactaccatggccgggtaatttttattatttttgtagagatgaggtctcactatgttgcccaggctggtctcaaactcctgggctcgagtcatcctcctgcctcagcctcccaaagggctgggattaaggtgtgagccaccatgcccagaccaggtatattatttttaaagcccacaatttttagctgttatgtaaccctgttcagaggcctttaaaaattacctgcgttctgagtagttgaggttgttctctgcctggtccttgaataagtgggtattatcattgtgatggtcaaagattcatgacatatgtcattcatctagtcttttgatttcaacaataaacgaggctttcaagttttagtagcctattggtttatggctagaactaaggatttttattgttccttatgatagtggacgaacccaaaggcaacttttggaatatgggagaaaagggaggctgaagagcttgccatttgaaaggtacatgattttgtttctcttgctcgtgttgattttatgttgaatttggagatttctatgtatcctggtattcacatgaaggtcatttcaatgacttctctgcttggggatttcaggaaacattacccatctcagtaccatgaacgacagtgcaggtcctcaccagacctcctctctgatgtgtcaaaacaagtaaggtttctgaaaatttctacttctttagataaatgtaatttgtgcaaatttcaaatgcttccatgaattgattctgccagaatcccagtgtgtaaaaaggttactctgtttgagtaggttagcttcctggggaggtctgtcagctcagtctttcctgccaatagaagatcatttagtaaactaccactggtgtgtaccttatagactggagagaactggcacatcttcaaattgcaacctgtgttgctaacatcttgcaaaatgcagatccaaatggctttgaattttcaaaactgaaagctccatctttttacctatgaaaatcttaaagtgtagaggaaggtataaggtcttgggttaaagttttagagtatttttcctgtgtaattttgtaacttaaggacaaagtgttgttcccttggaactgtgagatgatggcttcctttgacatttttagtatgaaaattgtgaattatttttcttttactctccctaaaaaaataattataggtctcataaaccctcatgccttcaagtcactggcagtttttatccaaaaggcatcagaggcataatgatgaaaggagccatttagtatatgaacctctcataccattcatagccctcctcccaccattttacagaaaatagggaggaagctggagcagcaaggttaggagacttgtctaaggtcacacagcaaatcagagacagagccaggactaacaggcaggactcctggttcactaatatagctattaaaccaaactgcttgtagtgtatacactcagagtctggaagtaggatggcattgagaaagaatagtgtcacatgtactttttaacacatgcactgtgatgtagtagaagttattaccctttctttatatatttatctaccctagaatagaacatggatcttgttaaatgactttatgaaaaactacctttcaaactttgaggctaatttagatccctcccccagccctaaccaaatggccttttccttctttcaccaatgtgtccattctctcaaggtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattata

SEQ ID NO: 3709 - DNA, 49972 bp, human; identical to SEQ ID NO: 3706

SEQ ID NO: 3710 - DNA, 51025 bp, human; identical to SEQ ID NO: 3707

SEQ ID NO: 3711 - DNA, 17270 bp, human; identical to SEQ ID NO: 3708

SEQ ID NO: 3712 - DNA, 49972 bp, human; identical to SEQ ID NO: 3706

SEQ ID NO: 3713 - DNA, 51025 bp, human; identical to SEQ ID NO: 3707

SEQ ID NO: 3714 - DNA, 27238 bp, human
tgcttgcagcccaacggcctcgctgagaatgctacatttaaaagtgcagtttttggatgattcccagaagatttttgtggttgatgtaagtggaaatcacattgctattattcctttattattcattcaataattgtcatttgtgaacagcccattagagagcaatgttatgtcttctttaggactgaatgaaggaggactgtgatttttagctttggaaaaataatctgtatttaacatcacaatgtagttcatatttttccattaacctttctcttagaacaagttgtcttttctcaagggacaacaatagcaaattttaaagacaggataactatttgcaaaaagtaaagcagcaataaactagttcttttacccaataaggtattgttgttcattgaaattatgtctgtgggtctcaccccatgagcatttgtggggagaaaactgttgttctgagggaaaggagtgggggaagctatcctccttttctgaagaaaacctatgggttataaggggtagaattatgtagttgtaatgagaacttcaggaaggaatgacaagtatgagagagaaaaataggataagagactatttagtttgatttagtacttatagttcagagttcttaataaattcctagctacaagatgattgcatacaattatacctcatctcttcaagaaagaacaaatgtattaagcacatcatttggtgctcatgttccaacatcttaagatatgtacattttgatgtcaggatttatgtatgagcattttgaaaagttctacatttttattggaaccaaaaatgctatttgctctgatatttacattagccactaacaagagacaaatagtttattttctctgaaattcatacaaaatgttggtttttttcttttatacataaactgacaactgctgtggctcagccatgatgttgtgtgtgtgggtagcccatttttccaatgagtattttatttttatttgaatcatgtgctttgtgagtgatgacttcatgtcttcatctgctgttttgctgtctcttcctttcagttttatgcgcaaaaggcatttctagttccacggacctgaatgatttgtttttgtagcaaatagcttccattagaggtatgaggcatttcctattctttcttggaactatatttaaggggtggaaaatatcttttgagtagtttatccatttgcagactggtggtgtatgctcacagtgctgcagtacctgaattagtgagctgggtattcaaaagatattgctttaggctaagtttttaatagatatttcaaggaactcaaagagaaatctttgacaaaaagtgacagaagagtttgttgaatgtgcagtctaattcagatccatttaaatggggtggagggtgggtaaggaacacagtaccatatcttcacaaaattcacctacggaagagccacttccagcaactagaagacttgatttggcttcaagtcaaactgtctctttccagctgcaacacattgtgttccttggaaagataatgggagagatttgatacccagcaattcaggtgtcaaagcatgtgatcccttttgctctgtggaagaatgctttgtaagtagcaaccatggtgttacccagagaggcaatagcattggctgcagtactgtgagtggctttgtccagaggagttagaagcttaagttagcattcaatcatccaatagtaccttctctgcttaacaataatagattgatgatgatgatgatgatgatgatagtgatgatgatgataatggtggtgatgatgatgatagcagtagtgagtcatctgtggatagcactttaaaatttacaaagcactttcacatccattagttcatttgatcttccattcagccttgtgagtgaaggtagggaaaagatcttttcccattttgtaagttaaaagatggaggctcagggaacttaagtgacgtgtgcacaatcacacagcatataattgcagagctggacttccaatccagaactctcccctctccttcatatacaattgtaaacagtagactcatctgtcagtagccttcagtattgccgatgcacattatttattttctgatgacctcacaaggcatagaacttggcacacagtgagcttttgatgactattgtgaaccagttagtagacccttcttttcttaatcatggttgaagaattatgtgggacagtgttccctcaaggtcagggagacaatggtgtgaatcttttcacctattcaaacacttaaaaaagcaacctaaagaatgctctattttattagtactaacattccaaatttgatgaagaaatgcttggaaccataatgaagagaacccattgatagctgaggaaggccacatggaggaccttttgatactaaactgaaatctcaagaggcatggatcataaccagggaaaattgtccttcaagataagattcaagaaaataattggttgcataagggaacatagtggactcttgggtattggtgttgattttatagaaagtgcagtggtagaaatataaaaaggacacatgatcagataaaataatgtcacctggagaaagctcattgacatccagaaccctttctccacccccagtactattatcttcctgaatttgccagtgtccaaggtctaactcaggcctcctgactaagaagcctgttttgtcactactccacaagaactggagtcagagactgacatttaaaattagaatgctagtgtcaccatttacagtgggattggggacactggggtcctctcatcatttatatgccaaatgatgtcagaagagccagatctggaagaattagatatatgatcctaatattcgatggcttggtaatgcatctgtgtccacagaggccatggcattgagaccttttagtcacgtattcattaattaactcatttagttaacaaattattattgaggacctaatatgtcccaggcccagttctgggaacagtagactctgctatattggtaggtaaagttcgtgagcaagagcacactctggcctggacatactgcctggatgctaccaattttggccttggttattcctttttctgtcattgcatgattgacaactccgctttctgatcatcctactgtttttaacttgttaatactttcagttagtttattagaaagagtggctgctcccaaatacatcttgttttcctgaggtttctttgcatatttgtgctctgagtcacttggtgttgattttatagataaattctctgaaaatattagtcaaccttttctttcatgaacttccaatagtgtttaggggtgcaggataggttatgggacttcacaattgctagaatgtgcctactaaagtacaatccaatgaagaaaatgaatttagtgaaaatgtcatcttacttttcaagccctcatatttatttcataaactgatcattgtcaaatattagcattattcttagggctgatcttacaacggacagcttatctttagactgtcaaggaaggctctctagaatgatgatgggagtgggtgagtgagactaaaaattgaataaggtcatgatttacaaattaattgcaggttttattgtatatttggttttgcttcttcaacatggagactagaacttttcttgaaggaaaaaaggaagataagaccaaagttaaagctttgtgagatattagaaacaatagagggtcaagtttctagcttgactatcaatctcttcaatatacacacatgcacatgcatgtgtgcacacactctcacacacagtagtagtgatgagtgcctttggagagcaacctcttgtttgctcatctcaggttacatagagagttgtacaaaatggtcatcccatcaccgtatttgacacagttctatctgatatccctttttgcctgctgcatttctgtctttgtaaaagctgttatttctgaatttccaaaatgatgtttcactttgatggtttctggagactaaagtcaaaacgagatgttaaaacatctctactttcacatttacctgattgctaagtgattgtactggccatgcagtgggtacccagtaacagaatatagtaagttagctcacctgattcccttgggagcccatgataaaggccactaggcctcatttttggaaagagacagagaggcagtgccaggaccgaacactgttcaagttaagtaggaaagcaaagcacagtgatttttaaatttattagtggtggaatttacccttgggatgtttgcccaggggttggtttttaaatttgcgatgatgaaggatcttttgtagtttagtcaacagtgaaatagataactgattctgtcacttcataaggcaaagttcttccaacttcaatgatatgaaattgctttggtgtaatagaaggtacctggatttgggactacaaaaactaccaaaaaacccaccactttagctatgtaatcttggactaatcacttatccccttagcttgctgagttgttgcgaggagtaatacaaattaggtaatgtatatttggagtctgataaaccaggatagatttgactctgccactgacaagctgtggagccgtgggtaagtcacttaggctatttgagccttagttctgtcaactgtaaatcctagacttggggtgccaggaaaaacttccagaagaacaaaccatttaagttgctgagtaggagttaagaaggtgaagatcgagaggtagattgtgggggaagtatggtgatctacacaaagggaagaacgaaggccaatattcaagagaacatggtcctttcacagaacaaaagggtcaatctaagtgaagaatggagtattgaaaggaaaatggcagtgactggaggtcaaagttgaagaagaggttggcagctagacctttcaggcaatgtattctatatgtgaagaagtgtgagaagtgtggtctttatcctgaaggtggcagagaccactgaagggtttaaaagtggggacattagcctctgctcatcatgcattaatttatgcatttattcattcagactatatttaataaaaatatgttctaagtgctagagatgccaggtagaatctgaatgttaccatcaagtttagtggatccaattttagagggtcaaactatatccaaacacatatgcccaaacatcgatattgcagcctactagggttctgaacttcgtcaatggtgaagacagacaggaaggatgaataaaagacatgctaatgaggtagaatttctagaaccatttgatgccacacttttggatatgggagatatgtgagaaaggatctaaatgaccttcaagtttctagcttaagtggctggtgggatgatggccccattcaccaagatagagaacagaatagaaggagcaagtttagaagggataatgattggttttgtttgagatttatagatgggattatggaaggaaaaatacatctggagtagggcagacctgaattctagaccaaaccccaacaatttgaaggtgtgagacttcaggtgggtcacttcagctctctgaggatgtgcccttatcactaaagtggagatgatcctagcatctacctcatgagatcattgtcatgataaatgagatatcagggataaggttcctgacacaaagcgggtgctcaaatttgttaattcccctctccctggcttacagacctccttatttctgtactttgcaaaccaacaaagaacagtctttcactttcaactggactttcttttgatgatgcttgattttgcaacccacctccaggtaatagagctgtgctcccccatttctgcgcttcctgtagggttaatttaccctgcctttttgcatgctttggcctctgtttactcagcagccccaagagatttgctcttccctttggagtcattaatcctggaagggtccataagaactccctagagttacctaaaataatgtagggcttcctttaaggaagcagatggaaatagccaaaccctttgcattttactacattctaaattgttccatggtcattattcacagttagggtaatacagttaataataataacaataatattactgaataataatcacaaatagcatttatcaacaattttctagatgtatttcccatgcactaccttacataagtctcatgcacatcaaataagtgtcactgactagggtttttatataacttctctgtgccttgggtttttttttttaatctataaaatggggataatattagtacctgctccatagggtcctaacaaaggttaaatgaattaatatatgtaaaacactcagactagtactagaaagtgctatataagtgtttgctacactcatgcctcatggaattcactccaattttagatggtgaacacatgtcctgcttcttatgtccaagcagtaatactccaagctgactaggcctaaaatattatgtttatctctattttatgagtatgtgaactgaggcacagagaggttgacttacccaaagtcatatggctatttaagttaacaggtgagctgggattcaagccccactttgtctggcttcaaaatcctgtctggacattgattagatggtaggcttctgactcaagcgtgatttctgtatatgcagtgaaacttcctggttttccagaactttatgatgtatcctctagcagatacatcacaagcagcctgcctaaacagcctgccccatgctaggtgggatcaatcgatgtttgttgatagactgaccaacagactgagcagatcagctcaccaccaccccgtgcctgtacaaagaaagccaagtgaaggagcttctaaacccaggtcagaaagatcatcctggaatcataacgttccaatctagccaatgttggctgtccctttgccagggattcatttgtcattgcaggggacccatactgcttggtgaatgcctttgtttaaactgaacttcctctgtcgttcatatcctgaggtttgttgctttggagaataaattgaactgaaaaaaagtgcttgtgctttctctggccccaggccaggctgagcagtgggtcaagcatggtttgggtgctgcctgccccaccctctgggagccccacatctcctgctgtcacatggcttccaggctgctttcctgctccagttcagagcaaaggcagggcctccagccttcccactcccactcctacctgccccttggcttcccatccccacagctgaaaggaggagggaacccgaacgcaaaaacatttgaggccatggcggaagagattggggaactggctttggagctataggtgggtggcgtttggctgtttgttcaagtctgcactcgtgggaatctctgtggaaaatttcagttagtcggggccttgccgcctcttcacctttcatcgcagggcaggcctgcctgctgcctggtgctggggaggagtagcagaagttggttcactgccctgcagccagaacgatctgcagatcttccctccgaattagactcgccagagatgattcctctgaattctataggagtttctctctcccgcttttaaataccctgcatttgcatcattgttttgacctgtcacaaacacaaatgtattactctaataaaggcttaactttaatttgtgccttaggacaatgaagctgtcagttgcaacttggagaaattcttcaaactgactgagctgagtccaaattgtcttggggtcaaaagggcatggcctgagggggaaaatcatctgggaggcggctggactggcccagtcatttcctaaaagagcctggagactgccagcccagcagcagggagcagtgcctagcttttgtgatactaggtgcctcttagcagctttgtgccagactgtcagaactggaaaaacattccgtgagaccagttctactgctgagagaaccacccttaacagttcatttacaccccaggaggtagtgccgagctggccaatgaggtgctagggcaaggcaccactgagaagacctgctgaaggctacaaagctcaggaagaatgaaaggtgataggcgttccgaggaacatttttctgggggctgcggaactctctgatgtatatagcttgcctggttctaaacacagctgctgtgcaaaagctacaattattacccccacatcatctaatttcagcccctttttctgtattccttctcagcctctttacccacttcctcctcttctgggtccaaggtgtggggccagaaaggggaggtttggctgggtgagctgaccccaggccctggaagcacttaggcatggcgcttcaccactaatcgctgggcttagttgtcttaaacaagaggtcctttgtcctctgagattccttctatgatgacgaaattcacctttcaacagacttttaaaaagacaaagattctccagaacttcacactcagaacattttaagtgattgtaagagatctgtgacaaagttactgtcaattgcctttaatgctatgagatttcatttcctgacctagctgcatgccaggaacttccacttacattatttcatacaatcattacttaatacgtctgtgaaataggtatgattatgctccttcattcattcatcactcacttaacaagtcctcactgaatccacacactgtgttggctattgaggatgcagagatgaatgagaaatagtacctaatctcaaagagatcatgggctaggggaagaatcagagatataagcaggtatgtatattatggtgtgatgtgtacaaatgacagtggaaaggataatttttttttctagcacagcaaaagaggggcatctaacctagattgaagtgtgtatgtggaggggacggacaggcaaggtttttctaaggaaggtgatgtctaatctgaaccccagatagccagtactaattatttaggtatgtgttggggagttggggggctgtgggggagcagagatgaaggttggtccagacaaagggagaagcaggaaaaggcctgtggagtaggttaatctgattgaatcttaaacttgagggcagaggggactgagagagagcgatgagagactgagggctgagacaggagagacaagcaggaactgatgagacagctaaatgcccaggcagataaaaaggggtccccagagaatctctggcccactccacaagtgtttacatcagatgcttttgtgcagatgggggaacctgcccagtgccttgtctgagcatgcccacatgcgcactgggagaacagggtggagccatgggcagggggaggagcttggcctccagttcctgtgtggtggcctgggattcaatctgtgaggtcagggacctattagcaagagctccatctccctttgctgagtttttttttttcttttttcccttttttgcccaataaaatcctgccctactcactcttcaatgcgtctgcgtgcctaaattttcctggtcgtgtgacaagaacctggttttagctgaactaaggagcaaaattctgcaacacaaagtcataaaaaagatttttcaaataaagaaatcaaggttcagcaaggttaaatatgagctcaaggtcatacaactgcaagtaagtacttgagtcaggaattaaaagtagatgcgttcattccaatccccaactctctcccctatggtttgctgcctctggaattctgatgcacagtttgggttcatataattctttcactactttaccaagcaagaactaccactgccacgattccttcccataatttgtattcatatttccgtatttaattaaagttttacacaaaaaattattagacattttagtatttaattcaaagtctcaagcaaaaataagacaaccaaaaatgtaccccaaataagctgggaaaattcagtttctggaaaaatgtatcctaaggaaataaaattttatgtaaagatacatgtacatctttgtgtactaagatgtttattttagtgttgtttgcaatagctcaagggagaaaacaacttacatgtccaacaaggtagtttcatataacagtaactaatgatgatattcacaatataatactacatttttttaaaaaagttggtcaccaaaaggtgttattacatcacatgcattgagctttactctgtgatccttagattggctgtctcttgataggtgggattaggagtaccttatttcttcttgcttttctgtttcttttgttccctgctttttaaataagcatatattgcttttggaatgaggccaaaaaaacaaacaaaaaaagagaaaacaataaaagaatcttcattgaaaacacagttccaatgataagtatgtgaggtaaagcacgttacctcgatttagccattgcataatctgcatattttaaaacatcatgttgtacatgataaatacatataatttttattcatccattaaaaataataaataaaaacagttgctgtacatgatccactacctgcataagcaatcaaaagagggggttcttctcatgacggcagggccacactttcccagatgctcatagccacattatgtgatatgtataggttctaggcacttgctccaaaatatcaaccccattccctactagcctacaattattactcttttccaacctaaatagtaatggtaatagctaatatatatcaacagaatgtttattatgtgccagacactagtctaaatattttacatgtatcagctcattgaaatcctcaatgaagtaggtgctaccaatattcccatttgacagatgtgctaactggaaagaggtgaagtaactttcccaaagtcacagaacagtgagtggtgcaaacaggatttgaacaggggcaagctggattaagagcccatgcacttgaccactccatccactctttgaagctagtccttcaagaaccaccatgttgcagttatctcagcattttattttatttattttattgtatttttagatttcattttattttaagttctgggatacatgtgcagaacggacaggtttgtgacataggtaaacgtgtgccatggtggtttactgcacccatcaacccatcacctacgtattaagccccacatgcattaacaattcatcctgatgctctccctccgccggccccaaccctgacgggccccagtgtgtgttgttcctctccctgtgtccatgtgttctcattgttcagctcccacttatgagtgagaacatgcggtgtttggttttctgttcctgtgttagtttgctgtatctcagcatgttatatcttaaacggctcttatttgtgttgggagtggttgagtaaaaaacagggtcagcagttgctggtgaagtgggccttgtaagagctctgagagagctttcatgtacaaatggaaaatggaaacggttcagagaaatggacaaggttagaaaaatacgtggcatctgagaatcatgaggccagaaagaaaggtcattctttggagctcagtgggtggggttatgaggccaaaaggatgcagtaagttcctttaactttgagaaggcaagcaatagttgttgaatagttactgcttactctgaaacataatagatgcttagtaaatatctgttaaatcaatgtaagagtggattctgttcttgctctcagctgctaggcagctaatccttgctccaatgagttagctgatataatgtcagtcgataaaacattctaggaagttaagtgttaagtcgggaggggtgtggtgcaaacatttcatgtgttagagtaataatttttttcctggaccagccctgcacacatgtgaaactgtgtggtcacagtatgccctcactgactattcgaaatggggttgccagaagaaatgagaaacgccctgcctcagacttccccaaagtataacaaatgagaggtcatctctattcctaggaatctacaaagactcctcaggtttctctgtggaagccaccgtgaacctgtttattcatttctgcatttggaggaatgtggactagagcctcctaagttgagaaaagcaaatgtcaaattcgacattgagaagggaagaatatctttggttttgatttttaaatagcaatgagtcagcttaaccagatccttctgtacaaataattccacctaagcaattaaaggagaaaaatattggaagatcttgcattgggagtgtacaactaattttaagacacaaaggttagtatcccttgggatgtagtttcccattaaagattgctaataagttacaaatcctaccactactcccttctcaggtttcccacaattttacatttagaaagttaaaccatgctttctctttctctcttgtacattagtcttttagatgtgtagtacttaaaagaaatgcatgaaattaaaaatgtcctgggtttggctgtacttgtacctgggtacaattagagaattccagacaactgttttgagttatgctgcataccctaaaaatagagccaccatatttaaatagccttgaggagaaaggatggcagaggtccttaaatctggggccagccccagactaatccagactgagaagaatctgcaatcactaggcttacaagttcaagtcactccaaggctcacaagtgtgagttagcacttaggactgggatgactacaggctggtgtaggctaaaagaaaaggggcagaaagctgtaagcaggccccggagttaagttacactgctgagctgtaagcagtcccaggagttaagttcaacaaatctttgagaatcacctacagtgtgcacgacatatgtggtgatcggtcaaggagagagcagacctaagtggaatctagctggttgccattgtaagtccaagttagtatcaaacagcaggaacccaagtgaagagactaggtgaacatcagggttaggaacttggatagatgtgtgggtagaaaaagaagagtgaaataacaggtcctaagtgactgctgcaaaggtggagcttggcaagaagccaagtcaagactgaggcaggggcctcttgtatgtttcctgctgtagggcagaactggtcccttagtgtagtccacaggtgtcaacaagcaagcacacctggctaatgtggagatgtggaaaggatgggaaatgagacactcctggacagggagatcagcttgagtgatagctcacatgacatctcatttttgctaatcagtttgaatcctatagaggttgtatatttttaatttaaaattttatatccagcttcaaaaacaatagaacctaagttcattataaatagatgagaaaattcggtaaacaaatgaagaaaataaatttcaagtataatcctaccaccaagattttaacattttggtgtgcattttatacattgaaattctacttctttaatggacccctaaattccacatgtgcctccccattccatttagtttggaatagtttcctgaatatatttaaaaaggttttctgttcagtcaatgcagattccccacagtaaccctaatatgctggctttcatggcctcttagtaagtagatgttttataaggcattataccttgatgacttctttatagggtttctgtgaaattcacaacctgtcagaacagcatggcttccaacctgctcacagccctgctgggcaacatagtgagcactgtttctaaatggagtaaaactgattctaggaacaaaagagacagactcggggagcaagtgagaaaagggaggctaaaggagaaggtgaaacattgaagtcataagcagaaggtgggaaaagtgagtcaaggatagagtccaaaggtgagaaaagataataaagtcaggtaacatggttaccagaggctaggaagagtagtggggggttggagacttggggggaggtggggatgtttaatcagtagaaaaaaaaatagaagaatgaataaaacctgctatttgatagcacaacaaggtgactatagtcaataataacttaattgtacattttaaaataactaaaagagtgtaattggattgtttgtaactcaaaggataaatgcttgaggggatggataccctattgtccatgatgtgcttatttcacattgcatgcttgtatcaaaacatctcctgtaccccataaatatatacgactactatgtacccacgtaaattaaaaaatgtaaagtgaggtaaacagagtgactatgacaggaagaaatgaatgaaaaaaacaagttctagctgtttatctctctcttatcattcatccacctagataatagttttctctttacatttaaggagagcctggcataatgaaatgagcccattgctggaggccagaagacctgggttccactcccaggtctgccattaacctgctgaaagatcctaggcaagtctcttacctgctctggatctaaatctccccacttgtaaaatgatgggcttggagtacatgatatctaatggtctgttttgtcctgggtatctcatattgctaggtatatacagaatcaatttcacgttaaaatataattccaagtaccatttagaatttggttgtgtatcatgcacaccacatggatttaatgttaaagtgttatgtggagacaaacaattataattgttttaattacccagagtagctagtaatttctataagacttgggagcactgtcttaagaatgctattattacactgtcacttttcaacagtctttccaatttaggcatgataatttcaatgtcccaggagtggggacaagattgctattaggctgataatcttactggtaatctttttcttcacccctgccccccttagtgtgaaggttaacgctgagcagtgagagtctcttagactccatccagttacttcaccaaagaatgtgaatcagatgcaacctgtccaggtcattgtcaggcctgcataaggcctcaggcaattatatataatcacttccttgtagctttgaaaaggtgtctgacagaaggtatcatctatcaggtaccggactagctatctgattccagagttctcttcctagcttggtttggttggcatcaacatggctgtggatatagggggtggtggtcaggcagctgttcagcttgattctccaggaccccccaggatagtcacgtgggccggaaatctttctgggcagttaatcctaagaaacgttaagccttccatctttcacacatgcagcactttgaactgctttatgttttcagaaataaaataaaaaccagttgtaatttggtgcgaatttcacacgtgcacaagcatctaaaaggcttgttctctctgcttacccccaccaggaaaccttaagtacccagtcaaactgtgcttccctccagggtttattgctgagtcctgtgggctctagggaaagggccttggttccttcctacttattctttgttctttgatgtgtctaactgcaccttgctctccaccagatgctaaaaggttagactgcctgcagagaactccattttagaaggaaccgctgctacctggtaattagcctctcaccactcttagcagttttccttttaccaggagttaaaaccccaggaagggttacagtttggtcaatgaatttcttctgcctctgccctgaaggagctccctttcctcgttccctaggtgatttactgagtgcaaactttcaaattatgttcagcttatttcctagaaaacttgttgcagctgcctatattggtataggtgtaaaatatgagccttttaaaaaaatgtcagaacatttgcatttttaccgaaaagtaaaacagtctttaaaaagaatccctcctagggtttattcctcaagaagttctgagattcctggatgtagcctgcagaaaaaggcttaccttcagaggggtttaagctctctgtaaataaggtgcacacctattgatgtttataaacagagctcagtcgaggtgaaggagtgcagaccaagatttcaccagatggctaaaattaaatcagcataactgaaaacatgcttagcctagaattgcactaaatggtgtcaaaatgcagaactatctccatacttcctgttctaattaacacaagtccaatcctctcactggagtgttctgcttggttctggcttccaaaatgctattcggagttcaggatttgaagagtaaaagactgatggaaattagccagaaggaactagttcacagttgtccccacaaatatgctgaatgacaatgtgcttatactattatagatggaactggttctgggccagtgccagagtgggtgattggggtaagttacaaaagggataatacatggagaagctctgaggttcaccaaaagaccagaagaaaaataccagatggttggccagacacactggctcatgcctatagtcccagcactttgggaagctgaagcaggtggattgcttgaactcaggagttctagaccagcctgggcaacatggtgaaagctcatctctaccaaaaatacaaaaattagccagtcttataactcagtctcaaaataagtaaataaatagataaaaaatttaaaaacaaaattaaaaaattaaaaaaagaaaatgccaggtgctggacttaaatttttatatttatttttctttttatttgagacagaatcttgctttgttggccaggctggagtacagtgatgtgatcatatttcattgcagttgaactcctgggctcccacctcagcctcctgagtcactgggactacagggatgcaccaccatgtccagctaattgtttaatttttatagagacagggtctcagtatgttgcccaggctgctcttgaactcctggcctcaagcagttctcttgccttggccttccaaagctctaagatcacagacatgagccactgtgcgtggcccaggtgggtgactttaaaaggaactggtgaacaaaataggttgtcagaaggagatttcataagttaatgccagcagaaagcttttgatatgagaagccatgattttcttttcagacctgtgcaaaggctacggagtgttgaaggaggggttcaaatatgtgcacacattggtgaggaatgttctgagcatccccactctcagataggttggtgtggggagaattcagtaacaagggatggagagtaagtgaggcaagctgcttgggtagccccttgttgtgcatgtggtctgtgggccaattggtaaagaaacaaatgtcaaggatgagcaaagtgatgcataaaggtgaatgaaagacggtaaaatgaagcctaaactcagcgatgatggacgcaaacccttatcccagcagaaggcaaaaggggagcaagcctgtaagacctgcaaagagaataccaggaatctctaggacactctctctctcttaacctccccaagtccaactgcacctattacagagccatctctcctatctttacctctttgtattctcactaccactgtcttaatccaggctaccatcttctctcacctgaattatagcagccccaacctgactacctgtcacctgttttaccccctcctccacctatcccttaaaccatcattcctcaaagtgtagcccacagaccagcagcatcggtctcacctggtagcttgttagaaaagtatattctcaggcctcaccacatatctatagaatctgaacctgcattttaacaagatccccaggtgattcatatgcactttacagcttgggcagcagtgccctaactacttttaggctgctgtctctaagacacaactctgaccttgtcaagtccctgctgaatatcatccagctactcctaaccccaccctgtacctcaccttcaaggcacatggcttcacatgccacaacaactccccttggtatgacttctgcccacttttccagccccagggtctcattttctcctttagcaacaccaaactgcttgcagtttcattgttcaaaccaggttttctaatctcttctgcctctaacactcttcttctttccgctggctaactccaattcttgcttcacacctcagcttagatgtcccatctgttaggaatcctttctactacgccctcacccatctttatgggttaggtgatctcacattaccccctgcatacatccctccacaaaatcacttagctcaaactgctgtgattaaccatggatgtgcctgtcttctctgccagcctatgtgttccttggtggtaatgcctgtgtcttgttcatctcagtgtccctggagccgaggagagtatgtggcacagagcaggtgctcaataatctgtgttgaattgaagggacagtagaaaggatcacaaaagggtaatggcatacacaaaaaggaaaggaaagggcaggcacatgaaaattaagcccagagtttgggcagataaaaattacaaacaggaaaacaaaagagctcgaaaaatacaataaacaatagagtaaaaagcatactaaaggagagatgaggcgttgacttttaaagtgtttattaaggagaaggttaagactgatgaaacagttctctgtctctgtttttgtgtatggctgttatggctgagacttacctatgaaaatgtggaatcagagggttaaaatgaccaaaaggtaattcatttacttgccacctggagagatgatcagctgatactggtttatctgagagaaaaccaatagttatgtgtgtgattctaaatattgcagatcttgaatattcaaataaatattgcccttgtcaaaatagacccctcagatggtgcaaatgctaatagctaggtgtagcctgttctcacactgctatgaagaaatacccgaggctgggcaatttacatttgtttaaagagctttaatgattcacagttccgcatggctgggaaggcctcaggaaacttacaatcatggcggacgggcacctcttcacagggctacaggagagagaatgagtgcaagcaggggaaatgccaggcacttataaaaccatcagatcttgtgagactcgctcactatcatgagaacagtatgggggaaacctcgcccatgatccaattaccttcatctggtcccgcccttgacacatggggattattataattcaagatgagatttgggtggggacacagaaccaaaccataacaccaggtgaccacacaccaggatttgtccaagacaggcctggtttatgcctgttgtgataatatccttattacaagtgccccttgttatcctctaaagtgtccaggttaggttcataaattatatggtcacctagaagtagtcaacacttattgagttcttcctatgtgtcagacactgtgtaaagtactttacatgaatattctcgctagaagctccctgtgatcccttttgagatagacatacagttcacataacagtaaattaatcaaattcatccttttaaagtgtacaattcagtggtttttttgtatcttcattatgttgtgcaactatcccaaccatctaatcccagaatattttcatcacctccaaaagaaactccatgctcattattattcactcccacccagctgctggaaaccactaatttactttcagtctgtagggatttgcctattctggatagttcataggaattgaatcacataatatgtgactttttctttctggcttctgacaattctattttacaactgaggaaactgaggctcagagagattaagtagcctacccacgatcactcttctagtggtagaggagtcagaactaggcccaggtgtgtctggctccaaagcaaacattcttagccaccatgctgtgctgccacctcatatttattgcaagggcttagcacattcttggaactcctctttggccctctgtagctgggcacattctttccaaaatgcctcacaaatcttcattatttgagagggaatttagtgtttgggaagagccaaaagtcataaaaagcaaatatggtaacaaaagtggaccatcaagctgggtcattgctatagactgacttgtattctcccaaaatttatatgttgaagcgctaaccctcagtgtgactttatttagataggacttttaggatgtaattaaggttaaataatataaatatggggtccttatctgataagattgttagctttataagaagaggaagattctccctccctctctctctctctctctctctctctctccaccatgtagaaatatagtgaaaaggcagccatttacaaaccaagaagagagcctttaccacagtccaaccatactggcaccctcatcccaggtctccagcctctagaaatgtgagaaaataaatttctattgtttgagccacccactctatggtattttgttatggaagcctgaactggctaagacagtcatatttggggataaaaaatgaggcataaccataaagtcaggagaatgaatgattatcatctgtgactttgagaataatttcctgaaggggtcataagaaatattttgaatgccagagtcagcattggaaacaggggaagcctctatctataagacattttgtatgacactatgcttttaacatttagaatatctattgtatttctctggaaaatataacaagtataagcaaaaagtaaaaataacccattatgctactattaatgatatgctatatttccttccaatctatcttttcctgaaaccttaattgtatagtctgtatttttttaaagcacacaattaatatgtaagatacattaaaatttctctctttttaaaaatcttttaattttaggtttgggtgtacatgtgaaggtttgttacataggtaaatttgtgtcaagggattttcttgtacagattatttcatcacccagctattaagcccagtacccaatagtgatcttttctgctcccctccctcctgccacactccaccctcaagtagacctcagtgtctgttgtttccttctttgtgttcataatttctcatcatttagctcccacttataactgagaacttgcattatttgattttttgttcccgctttagctcgctaaggataatggcctccggctccatccatgttcctccagaagacatgatcctgttcttttttatggctgcacagtatttcatggtctatatgtaccacattttctttatccaatctgtcattgatgggcatttaggttgattccatgtctttgctattgtgaataatcctgcagtgaacatttgtgtgcatatgtctttatggtagaataatttatattcctctgagtatatacaataatgggattgctgggtccaatggtagctctgcttttagcttgttgaggaattgccatactgctttccacaatggttgaactaatttacactcccaccaacagtgtataagtgtttccttttctccacaaccttgccagcatctattattttttgactttttaatgatagtcattatttttaataccatttgaattgcgtgaaatggtatcttattgtggttttgatttgcatttctctaatgatcagtgatactgagttttttaatatgcttgttggctgcatgtatgtcttcttttgaaaaatgtctgttcatattctttgcctactttttaatggggttgtttgtttttctcttgtaaatttgtgtaagtttcttatagattctggatactagacttttgtcagatgcatagcttgcaaatattatctcccattctgtaggttgtatatttactctgttgatagtttcttctgttgtgcagaagctcttaagtttaattagatctcacttgtcaatttttgcttttgttgcgattgtttttggtgtctttgtcatgaaatctttgcccattcctatgtccaggatggtgttatctaggttgtcttccagggtttttatagttctgggttttacatttaagtctttaatccatcttgagttaattcttgtatattatgtaaggaaggggtccagcttcaatcttctgcatatagctagccagttattcaggcaccatttattgaatatggagtcttttccccattgctagtttttgtcagctttgtcgacgatttgatggctgtagttgtgcagccttatttctggactctctattctgctccattggcctatgtgcctgcttttgtaccagtaccctgctgttttggttactgtagccctgtagtatagtttgaagtcaggtaacgtgatgcctccagctttgttctttttgcttaggatttccttggctatttgggctctttttttgttcaacgtgaatttaaaaaaattttttttctagttctgtgaagaatgtcattggtagtttgatgggaattgcattgaatctgtaaattgctttgggtagtatggccattttaatgatactgagaatgtcttatttcaaatgttgttgaaggtggttgttgatcagttaattgacaaaatttgctaaagcaaacactaataacaaatcatatacatatatatacagacatctcaaattttttattttaacataaaatgtatacattttattcatatcctaactgtttgatatagggtcaagaccttttctttagtatggacttctgattgtattcccttttgtctttcttccataaaccacatccataatctgtcatcgatgatttccagtcttggtttatttaatgtggaacaagaatacaatgatttcaaagcagtgagtacagaatctttccagattttgatgtctttcctccgtcaatcttttattgctgtcatatccaaaactaatttgacagcacatttttggggactcccccttattgagtctttacaaaaatatcaatttaagtttcatagaaacaactcttgccattagtgctcataataatttttgatatacataccatttaattaaatggtgtaattataataataagtagagcttgtcaaaaatattttcaagaacataatcattagtaagcatgggactcaattggtcactgtcaaagtgtacaattgtatttgagtcacctactagccatgagttttcatcacaatgtgggcatctgccaattttttgtttgtttgtttgttttttgtttttttggttttttgagacggagtcttgctctgtcgcccaggctggagtgcagtggcacgatttcagctcactgcaagctccgcctcccgggttcacaccattctcctgcctcagcctcccgagtagctgggactacaggcacccgccaccacgcacagctaattttttgtattttttagtagagatggggtttcactgtgttagccaggatggtctcgatctcctgacctcgtgatcccaccacctcggcctcccaaagtgctaggattacaggcataagccacagcgcccagcccgcatctgccaatgttttaaagagggaatagaatgcattatatgcacattattaagtggaagttggttaagaaagtttctaccatccttgcttattaaaaaaaaaattcagacacgtacagagtaaaaagttaaagtcccccttattttatctcctctccaggaatattgttgttaccaatttggtgtatattcttccagatttattactatgcatatatctatacatgtgcattgctgaagtgcatatgcatatgtgcatgtgcatatgatgtgccaggcactgtactaagaccttgatgtgaattattttatttaaccctcacaacaaccctatgagataatatcactattatctttattttacagattagtaaactgaggctcagaaaagttcagtaattgcccaaggtcacataatgactagtttgtctctctcttaagaggactattatactaatgtacatgaatcaagttaaatgtctgggtccatttatccacttactcagtaaacatttattgaatgtccactttgccaggcactgtacttaattccaagaattcaaacacgtggtttttatcttcagatatctagaagaggtagatcaatctgtgagctaaatgatttgccccaattcgtccagctagtaagtgaagagagcaagattacaatcccgatttattttaacaaattggtatataacaattgttggtgcacagaaaatttggtagatttgtttttagagctagccactttgaatattattgtttccatgagaagatgagtttgaagcccccaggaatcagtgttcaattgttatgacccaataaattaaagattataaatccaagttatgaatgatttgtttaaattatagagatagatagatagatagatagatagatagatagatagatagatagacatttaaaggcagatatcaggatgagacaggattcaggattggagttccaattccttcagtgggaggactgacgggtggtaaagaatttagatctgctaaggagcttgattaggatattgaaaagtaccagcttaaaaaagaccaagcaattgtacagagaatcagaagtccagagaaaacagaaaagagaaagagaaaacaggaagcttgtatataaggcagtattacaagaaagagaaacataacaccaaaattgagaaattcgatcataatggtagaaaaaattaaaggctgcatgttgagacagaaccaagaccttacctattacataacacattccacaaagctggccaatttcaacgtacactatggaggactgaaggaaaatgcctctcgcggagatggggtggaaagcttgagccacatgagtgtctgacctccaaaagcataaatgccaaaggcttttagagccagttggcaacacttacagggatggaagaatcagggaattattcttataaacatagtatgggatcttacggaaggaagcaaaacgaaggccttaattagaaaccttaaaagaatggctacatatgctttgtaattgcagaaacatgtaaatatacaaacacatggaacatggcagtgttgatagggaggattaagtgccctgatggaaaataagaataaaatatgaaaaggagaaaggaaaatcttgagcttcttaaattgcttgcaaaaaaaaactggagtgtatgatggaatttggtcctcatgactgaagtgtttctttggtgttggaaaaagtattgctgtcatctctctctctttagaaattctttttttttttcataataaaaatcccatggcagctccttgtctatgaaggattttaaaaataggagcaatttcatgtgtctgcaatggtctgtgtcagcacttgccctaggcaaggttgccacacaggcaaaaatgtacccctctcccctataaacaggccctccctggcaaccccattcccttggtgccaccccccccaggggaactgacccccttttcttggactacagctccattgtgatctcccacatcaaatcaaaccccctttcccttggtagagcagctctgtctccaggtgcaagggatgaaataagtttcaccctttgcagcctattttcatttaaaaatcggactggggttaacccaaatgaatcttgagtcggtggagctctgggcagtaaaaccaagtagagagaagtccatggggagaggggtgtatttttggacggtgggggaagcgggtgaggtaggccgccttcctgaaaactattaaatcccagatgtgggctctgttcagtgtggtgctgccttgagggaggggggaattggtggtggatggactctctgacctctcaaggttgctgttaattctatgggtcggtgatttccaactacatttccccgcgcctggcttcctttgcagcactgtaggcaccgcgtgactcgcctttaactaggggttttcagcagccagtctttgtgcctatcagccagggctcaattttcccatcacggtcctccctgcaacagcaatccctgggttcagcaatagtggaggcaggctgaaaatcagtcccagccatactcagctcaaagaaatttttcacagagagctcttcaaagctcctgttctcagagaagcataagaaagggactgttttgtgctcacagtgtgtgtgggctttatgaagaaaaaaatttgtggccttatgtgaacagagtatgctgtatgcagatttggtgggcaaagctacaaaatgaaatctactcaaggggctcatataatcatatggtcaatttcatgttggatcaacaaacattcaggagcccagtactatgtgccaggctctgaattagaactggtgagtaacaagaaaaataaagcaaagtccctgctatggaggaattcagtctaatggggaagatagacatccagggcaagaagtgctatgcttgaggtaagtgagggtgtttggaggcataggggagcttgcccttggctcagcctgcggctgatagggattgaagaaaccttctctggggagatgacatctgagctgagtaggagtaagccaaaccaaagaaatgtggaaagagcgataggtggagaaggatgacatgagcagaggcatgcaggcacgcaatgactagacaggtatggggaactaagagcaggctgccgttattagagaggaaagtatcaggaggaggtgggcaagaggctggaggcgcaggcatggccacaggagggagagagaactgggtctcctgtgctgaggagtacaggctttatcctgagggggtgccactgaaggatttcaagcaggggagtaatagggttggatttacatcttgactaaactatctgtcaatttggaagaaatcattcaaattgcccatgggatgaactgattcaagaattccattgaaagggtaaatttgcagatgtagccatagttaagtgcaagtatttctttttccaaggtggtttgttataaggctttcttagggatgtcgctaaaacaacacagagacagataagtggatctatctgtaaaggtcaacatctttgaaaaggatgcaggtcctctaaacagtgcttaaaggaaacagggcttgcagagagtcttgtggcttctaccctttattccgtgctgcagtatcaggttaggaatgcaaattgtgctatcatctttttgttttgtttagcaaaagtcatccgggaaggcattgtttaacctgagttgcagccatctaaatcttgctgaaaaggaatattttggattagaat

SEQ ID NO: 3715 - DNA, 61541 bp, human
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaaggtgagtcccatctgaatgcacataatttaaatttgttgatttctatgttttttgaaatatgatgtgctttgaaatgagtaaaattaataatagcatgaaagtgataaattttgtttttttaacaaaaaaacagaatgtcaagatagaaggtcttaaagtcagaatgtcttaacgacaaaatgtcttaagtctttgtgtttgtagagctaagccaagtctaaagctcattccaccaaagaccacttaccacttatcaaaacagatatacttaaagaataaaaattgaagaatttttgtaggagtgagggattgtagccttgctatcgtttacttttttgtatatgatttagatgttacagtgatcataatccccatgtaacctagagaagcccttcactgaattatagcatattatccatagtaccaaaatgcacttaggagggacttgtcagctttcagaggataactaaagtcagactgagggagtataagggttccagaaggaaaattatggcattttgaagcgtctcaaagtatattttgaacctttaacttaaacgtattgctacaaaactaggttcacttaattttcctcctggacagatgattgaccaatttcagatttgtgagtatattttgtaaggaaagtcctattactaaggtcatcaagcctgagtattacatactagattataaacaaaatatgaggccagatgaggtattatataggacaggatgtatatgattgcagaaaaagaaaatgcactgattttcatgtgttattcatagttatccttaaattaaggataaaaagtataaattaaaacatagaagcaataaattataatggatttctggtttaattaagatttgctacaatgcatctgagacttttttcaaaatatgtcaaaatgaattaagcttaacaagaactttttcagtttcttgatattgttttaccttcatcatgaccaattttacctcattaacatttttatttatggctgcattggctaacagagatgtatcccttcgtgtgatggtttcctcaggaaacattttcttaagcgatatacaggttaagtatctcttatctgaaatgcttgagactgaaagtgttttcgattttttggattttagaatatttgcatatccataaagagatatcttggggatgggactccagtctaaccatgaaattcatttacattttatatacactttttacacatagcctgaaggtaatgttatacaatattttaaataattttgtgcatgaaacaaagttgtgtacattcagctatcagaaaacaaaagcgtcattatctcagccacccatgtgacatcatgttgacacttaaaaagttgaggcttttggagcattttatacttcaggtttttggattaaagatgcttaacctgtagtacttaaagggttacttttacttatttcgtgattactagttttttgttttttgtttttttttgcagaccattccattttaagaatagaaacttgttattgtaaagataaaggtaattcctaccattgaaaatctctgaattgcttttatttgtggtagacattatgactaaagaacttattttgttttcttcattttggtttcatttaagtttcatctacaattattttgtgtattatttaaatctgcagctacaggattgggcagtgccttgaagtggaaaagcatactgagttagttgggggaaaaatgaggtatctttcatctggtccatatagagggtcaggaactgcagtagaaactttgcattgttgtttcaggagatctggggtacagtcccagcctcactactgtatctgacctcgggcaacttaacctcacaatccttgagtaacttcatctgtaacagatagatagtatcttctgtacctaacttctgtgattattgtggagattgcagtaagctagtacaaatggaaaaccatatatcaatataaaagtgaattaaataaaaggttttcttcctatcaactaaatgtttgttgtaggcattctttaacaaagttctatttagttagggcttattatttaaaattacaaactcatgttccaaatgtacatgaccaaatctagttgctgtgtgttattagttgttcaagctaagtataactgtttttatggttactctgatatagagttccttgcaggctttgtaaattctatctttccaaacatcatagaatgtgaaaggagacatgtgatcttcctaatcattaataaactcaggtcagtaattccatttaaaggcaaaagagtgccataaactaaacattttgaagaaaagtactagggaaggtgactgtttacaaaatgcgtgctgcactacaactttagagcttggaaggtgtttaattcagagacaaaatagataatagccaatgaatattaataagccacttaattatttaaataagttgtctactcactgtatctagtgtttttaaagtaatgtttgcatcatgttaatatcctgatgaccagtcacacagggtaaagatgatttacataatccttacattctcatattttagtgaaaaccttaatatttcaaatatgtaaagccgttcaaacaattacttaatttgccatttagatagcacattaaacaaagttccatgtctgcacaagagctttgtagttcttatccatgacatgcatgaaggttaaattaagttgagggtaattgacctatgtgcattgtgctagtatcatatctataatatacaaataacatacctcagtggttactgcagcatttcctacttctcctgagtttttataattgaaacactgttgaacttcatctgtgtactatttcttctctcatgagtgattaaataactgaaacaatcatttgatgagttttgggctgctgcttttgtttttgttttgttttgttgttgttgtgtaagaattctattagtactagctactctaccagatgatggttattgccttaataacaggtacaacagatacaatgttctaactcacctcataatgagggaatgttatgaaaataagaagggcaaattggatggctgattgtgtattgtgctgaagtgctgtgcctatcaatccatgaatgttgagtgctcagtgatgaaggcagcaccatcttcaaatggaaatctagtgtagtccatggattaatttccagctacatagaatggtctcatatcatgttggtatgcagctgtttttgactctgttgccttgtggacttggcataatctgtctccaaagttttcttcaaagtatcgcttaatccattctatgccaatttcttgatattacagtttgccattgatctaggttggtatttttagtgaatgttccttggatttaacgaagggtcatcatttttaaaacgaaatcaatctttgtgattgttttcatagccaagttattctgcttcagcaatatcatgatgtcttgaacctttccctttatacttgaagcaatgtgttatcagtcactttttatccaggaaggatataaatgttgtcattatttcattatgacagatcaacacccatcacaactgtccacccctcttaccactttgggtagttttgtgccaagaatttcctggtaaaggccatagcagcagacatagttagaggatactcaagctaacctatatacattccttaaaaaatgggaactgggtaaggaatgcacataaaacagtcacatgccatgtcttcaaaatcacatatgatcacgagaaaaataatattttgacaagtgaaaccttgtcaaatattataagcatatcgatatgaatctatccttgtaggtcaaactggcccaagttaccagtatattctgcaatagcaacactagtcacagcagttttcattagtttaaaatttgactatttttgactgaatacttactcatccctatttgccaagggaaagtttaccagaaactagatgcctagcaacacaatcccaagggtcactggattatgcaagacttagcaccatttatcagctccatcagagaggtctgtctacactataaagacacataagcagcagctgtcatcttgagagtcaaggaaaataacattttatttaaggatctctattttctatgatgctaacctttaaagggaagtatctttgactggtaaaagtcaatgctattttggacatttcaaaaacctcttttgaaaggaaaatagaattacaattataggttggtgcggaagtaattgtgttttttgccatgaaagcaatggcaaaaactgcaattacttctgcaccgacctaatggtacccaaacaaatacatattgatagttcagcctcgccttttaaacattttattttgaaatattaataattttaggcttacagaaaagttacaaaagtgatacaggaaactcctgtatactttttatccagattcccctaatgtcaacaacttacatgccatgcattgcacagttatcaaaaccagggaattatcactggtacaagattcttaagtaaactcaagaccttatttgaatgtcaccaattttcttcctaatgttatttttctgttccaggatccaatctgggatcccacatggcatttattccttatatctccttagtctcctccaacctgtgacactttcccagtctttccttgtctttcatgaccatgacacttaggatgaatactggtcagttattctgtaaaatacatctcaccttgtgcttgttgaatgttttctcatgattagactgagatcatgtggttttgacaaataaaaaagaaacccacacgcagaaatgatgtgcatgacatctgagggtatgggatattgatatatcttattcattatgttaactttaattagctggttcaagtggcatctactggatttctccactgtaacatgaccagtttttcttttgtaaaaactgataactatgtcccccatttattcatcatcccctacaatatgccattgatcgtaatgggcatcccaatgtcctagatgttaaaaagtgaacaagtgttcatcttagaagtgattggtaatgtacttctataattatagtcaattaagaaagagagcaagggaaaatggaccaagagcatgacagagaaaatagcagcaacaagccactggaaagacagaacactggagagtgagcagtcctagaagtgatgtgatatgtgtgtgcctatcatatactactgcagagtgtgacagctgtccccttcttgttcatggccttgggacttagccgtgaaccagaaacagtccctgcctccatggtgcagacattctcattgggagttggaggaggagcaggtaaaaaataattaaatattcaggataacaatacattgtcaggtgtgaggaaagggtgcagagaatggcaggggctactgttttagatacagtggccaggaggcctccagtgaggtgacctttgaggagaggcatgcaggagatgaggggacagtgaagaggatttctaagaacattccaggcaaagagaatggcgacagctaaggccctgaagctggcggcagcctggtgtgtgtgaggaaactcaagatccccagcgtggctggagcagagccatgaagggggagggcagtgggagatgagggcagggaggtcccgggggtggggagatcaggtggggctctgtgtatcatgctgaggactttggatcctgttccaggagctggaaaggttgacataatcgggggaaagcaagcccacacaaagcagaggtgtctagtctttatattttttaagtggaaaagagaataatttccacgaagacaaataactcctgtttataggtgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagacattccatacatgcctctgtagtttgctgctagagagagagagtccttgtgcatgtggcttcgaactaggaagaacattggaagcttgtgctgggcttctcttgattctactgatacgtatatttttcctgttacttttcctctgtattccaagctgtaataaattttagttgcgagtgtaagttgctattgagtctgtgagtcctggcaaatgtcaaagaagcttttctgtatgttgttatttttcatacattatttgcttgattttttttttttacatttttctgttttttatgagaagggctttttcattttgtttctattttttaaagtttaatttttgaatggatattttcataattcaaaaatttagaaaaacagtcaactaatgagtacatcaacaaaatatggtatatacatacaatgtaatattactcagctacaaaaaggaacaaagtactgatccatgctacaacatggatgaaccttaaaaacatgatgttaagtgaaagaagccagacataaaaggtcacatattgtgtgattccatttatatgaaacatcaagagttggcaaatccatagagacagaaagcagattagtggttgccagggtcttgtgaagggcagtagatgggtgagtgaggggtgaggggtatgggaattaactactaatgggtacatggctttttttttaagggtgatgaaaatgtcctggaattagtgatgatagttacacaactttgtatataaatgtgttaaaaactactgatgtgtagactttaaaagggtgagttttatgatttgtgaattatactcaatgaaaaagtttaagaaatttcaacgatagtagagtatgcagcgaagttttcccctcatctcttttccccagttaatcagttgacctccaaactgatattttggttttccctctcccatagatattatatatatacatatgagcaaatatatccatacttattttccattttcacacagatagtagcatactgttttcctccttgctttttttgagtttaaaatattaacagtaaaaagatgggaaaagctatgtcatgctgacactaataaaaagaagcctggaggtgctatatttataataaagataaaaagaattgcacacaaatacaggattctagttagtaaatctgttcctcacaggcatatgtaagtatgtagatactgaggttgaacaaataaatgtatatagagtagataatgagagcctattttctcactatcagaggaaaaaagttaaaaataaaaagggaaggttaggatgaataccgtggtgtggattagaaaggacacatgagtatgtatacagatagatacaggaatagatattgatctgtgtgtatgcatgggttattatgtatgctttcatttcctagctctgtcttgggaagccctagaagcaattaacaccccaacagcaacgagtatacttagtacccacatctttgtgtctaatatcattctccaataaaggaactcgggatctttggaataatggctaattctggacagaagcagggaaaatacaagatgaggctgtaatgtcttttggtgtaagaatgtaagaaagtgctagagaaagggtgggggcatgacaagacagcatagtagccagtctgaaggagctcccaatggctgaagttagaataacttgagcaagaaactaaatgatgacagtattgaattatagctcatagaataaaatagatgcccatgagtccatagtttacaaaaaaaattgaataaatggataagttggggagaagggacaactcctccttacagaagaattccaattaataaatggagaacaaatgaaggaaacacaaaatcactagtaggcaaatgccatggtaataatggttgcaggcaagatccactgatatatgctgaaatcagtgggtaaaagttggaggagaaacaggatatttgcattgtcccaaagtatttctcccaggatatttatcaattaaaaatagaacaggcatggtctatttcatttatcaataaaaaatagaccaggcatggtggctggctcatgcctttaatcccagcactttgggaggccgaggtgggaggatcttttgaggccaggagtttgagaccagcctgggcaatatagcgagaccctgtctatacaaaacatttttaaaaaaattaactgggcataatggtgcatgcctgtagtcccagctactcaggaggcagaggatcgcttgagcctgggagattgaggctgcagtgagcagtgattgtgccactgcactccagcctgggcaacacagcaagaccctgtttctaaaataaataaataaagggaaaatagtcactttacagtggagaaacccagcagatgccactttaaccaggtgtttaaggttaacataatgagtgataagatatatcaatatcacataccctcagataggatacacaccatttctgtgatgttcctgccaaaaagacatggtctcggtctaatcatgagaaaacattcaacaaacacaaagtgagaggcattttacagaataaatgaccagtactcatccaaagtgtcatggtcatgaaagacaaggaaagacttagaaagtgtcacagattggaggagactaaggagaagtgaggaataaatgccatgtgggaacctggattggatcctagaacagaagaacattaggaagaaaattggtgacattcaaataagatctcttgttaagagtctcgtaccagtgttaatttcctggttttggtaattgtgttatggttatgtaagtatttaacagtaggggaatctgggtgaagggtatacagggactccaggtattatttttgcgatttttttgtaagttcaaaattatttcaaaatgaagtattttaaaagttagcttttttagtctgtcctttgaggctcagaaatattgtggggtattgtttcttttcatttttattcttaaaaaaaaaactttgagtatggggatgagaaaactctaaaatctagtcatgactgatcatgagattgcccccaccaaaagttcgatgactcagatatcttcatagttaagaaagcgctcatacatataaaagcacttcacaaacctagcaaacgaagaattttggctgtagaaggaagaacgttcagttcaaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatcagattttttcgaaatgtggatacaaggtacttctgtgcatccggaaatagcaattagttcttctaggaacatgacattattcatagaacattgtttacttactgttctgtttgcccttgcagatgacctttctgcatgtaccatccttgaggtgacccttgttttcctctcagtgtgtcacttggtccctgacttatggggttatatattccagaggaatcttagctgtctgctattttctgtaaatactcttttttttcttcagtgtttattctgctacataatcggtcttcagtttcttaaatttatggttttttttttttaatttttgatgtctaatccagatttgcagtcctgcttgggttttcaatgtttttgtttctgtgccttcaattctcaccccagggtcaagttttattgctagatgtcattacaagtttatctcacattttttgccatctttcttgatattgttttctttaaagtcagtaaacaattccatttgtttttcatccttttattttctaaatgatctccagtatttggattgaaccatgttgtatctagagatagagtaaatcatttttcggtatcttgtttatgatgagattatgtaaaattgcttaatgtcatgtctaatatgttatttagttaagtagatatggctatagaatctatctgttagaaacagttttgcagctataactcggtcataggcatttaaatgtatgccttaaattggatttttgtatatcataaataagctttttttctgttgaagctcaaattttttttaacccactggaaattggtagaaaataaattaggctttgcttctacctatattcttatgagtagatagtggacaatgaaggcagtttccacgttgaaaactgtacaaaaatttgaaaatgtaaagtccacagtaatataaatgtattacatatgacaaattccctttaattccattaaatatgacaaaaaacaagacatgtcctatgtatcagccatgatttgttagctaacggaacggtagtaatgttctaatttctgtcttagcgtgcaaaaatgcaaacagaaaacctttttctgtgactttaaactctttaaccatcttttatatgcatctaaatacagtgagtagattacattgtagtatcaataatctcttagctccaaatactttttagagatctcatttttaaaaaccacattgttttaagaccacattgtcacattgtcttaatatctttgttcatcttcccatttgtgaaagatagtaaaaccgaagtaacaatttgaggatttttaatagcttcatgtactctgtgttcttgttttaaatatttcacaaatacctatcctaggagttgttccacttaacaaacttaattttttccagcttttataaaaatgtaatctctagtgtttctgcaatttcctggttattttactttttttactaaccaaaaaaagtgttctatatagaaccaaattcagtcttaacttcagtattactaacaaattttaaaaccatagccatctttaatctcccagtaccccactgtaggaagaatttgactttggaatattgtctcatttttcaaaggagcctgagaagtagttttggaaaatacctttttcttgggtgaactctagatgtaaccactgaaaatatctgaaatgaaacattctatcagcaagtggcataaacatcgaaaatgctgccttgtcacacataacagttctaacaagggctccttatgtcatgggaatcctactacctctgtttctcttcatatgagagcaagcagcagcactgaatttgtaagactatttggttgtggtttcctagaaggatttgtataaatgtcaggggttatttaatgctgaaagtcctgttaaatccattaagaattgtatgtacattcaattccccaaagaaatgattcattcaacaaacatttattgcaacctcttacttgttaggcactgggctcagtaatgtggagaatacaaagttaggaaagatgtggttcttgcctgaccttttagtaagaggttacttgtgttatatgccataagccagatacaaactaacagctacaacagtccaagggcacaggtagggactgggattatattcagcagtggtggttgaagatggagtcatggcagagacactgtttgaggtgttctttgaagaaggaataggaaggtattccaggcagaggggataacctgagcaaagatagagggggaaaactgtgatatgtttggggagttgaatgttaagtcagaatggctgaagcatgagaaatgacaccatcagcttgtgcaaaaaaaatgacagaaaaaaagagactggcaagaggaagtacctcttagaaagttgttgaagtattgaaggtatgaaatattaaggttttgatttagatggtggtggtgggaagggaaaactagcgatggaattgagatgcagatgaagccaacatggttaagtagaaagcagtggatatttccctccagcctactgaccttgtgctcatcttaacatcagatttctttgaagttgcagtgaaagtctgccatactttttgttttgttttgcattagatgctatcttgtccaccaacatatcttttgtgcctagtacacgttagggcttggaaaaatatttgttgaatgaaacatgagattgttgaaacactttgaaagagggagaataaatatgggctcaactgagaggtacacagagatctcttcatctgcagctgtactttcactcccagttcagtttttactcaaatatagatgaaaattgtatacacccatgtgccaactttcctcactcaaccacattttaacctagatttgatggcctgcaaattgctgatatttgcaaatttaattccatcccttagcattatagaaatgatatttggctaaatgctgttggatattctccaactgttacattttcagtgcttttacgttatatacggatttttttaaaaaattacttagtggccattgttaagtgttatttttaagataattagtgtgattatgtagtaatggtctagcattttttgtcttaaaatgtttgaagttgaattttacagcagatgggtagcttgcaaatcaaggtattcttggaagcataatgagtgctaataaggtgattctaatcaagtacaagctcataatcttcaaaaagggattttgtggaaaaaggtgactgcctagttcaaaaatatatatatttaaagtttaataaagaactcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaattatggcccagagaagtctcattctccccatggaacttgctcttcctcattttcaacagcaccactaaacatgcaccactagttacctttgatctccccactgttcacaacctccaagcaggcgtcaagtcctaggtcccccaccagcacaactactcatgcctctagttatgggagagagaagatttgtaaactccttgtgggcagtttccatggcataatcttcatttcttccatagtatctagcacagtttttacttttatgcaggagaggtattaaacagtatgccttcttttatcaggctacaggagcaaatgcaattcagtacattttcctatttagtgttgccagaaaactcacagctaccttttgggcccagctgcagcaattaaccttagtctagaattttgaagtttttgatacaattatctccattgttccacctttcccattatatcagtctttacagttactgtaataatcttacttcaaaaatatctttcttgaaggtcattttgaagccttttgggaagaatgtaattgtctaagtagtaagagagcaagtcaacaagagaaggggctaattccatttctgcatttattatttgcagcttataaggctatctgagtgattttcatttggacatgttaatgtattccaggcattccagtatggttaactgggggcctcagtttaaaatgggcttccagtgatactcagaagtaaaccagatgcagctggggctactcgtaaaacagaaaggaataaataacaaatacttgaaactccttagacgtttactttttttcattaggaaaaaaggagaaagggttgtatgagatgtgttttttccttacttcctcgctgcagggtgcaactgatgaacttgtattcagtgcttattttgaggtttagtaatctattgatacttcggcttttgatcatctgtgctgaaatgctgtggtcagcattaaattgtttgcctaatcgatctggaaagtattttcctccttttagcttgtctttttctaggtatgttttttttaggggtgaggagaaggggtaatgttctcaaatgattgggatttctgtagtgagtaaaggtgtgagtttattggagagctgaggggcagtttttaaagaatcctttattcgttcaaatttgggtacacagaaaacatttagaaaacactctggaaatgtttatacagcaaatgtaagcaacatacaatacagagctctcatatacatacttaccatcataactaatagccctactttgtaaacagaaaatgaatgtgtttcctaggagtagtagaatagattttgagaaggccaatccttcttcatgacctagaccggccttcttttacgtggctgctaacatcattactgatgtcagagatgtagaattaaggtgtccaaatttctttagtatgaccttttggaaactgaattatcagtaccataataaaatgcatagcaaataactaaatccattgtcggataggacaatattcccttagagcaggggttctcaaaaatgtggcagactagcaacatcaacttcacctggacacatttagaaatgtaaattatcacctcacccacacctactgaatcagaaactctgtggggaggcctggcactttgtgtttcaagaaactctcccggtaattctggcaaacactgaagtttgggaaccattagtttagagaaaaccataattggtttagcagggtgtcaattaaggatgatgtttcaaagcttcataattctcaggattctgtgttgttcctctaatgcctcctccttcctcaccacttgttcaaacggccctttcttgatatatattcagatctgttggaagggaaatgatgtctattctggaagacttaatgtttctttgggagacctattatattttccctccaaggagcatcacaatgctttttagctgagaaaaggctctgagaggtattgcatgaaagacagtttagttctgttaactgcgtgttagtgtagtttagttctgttgaacccaagaatttctgtaaatcctttgatcacagaaccctatctttgtggagcatagagaaacttatggaatgctacataacaggtgactgggcaagaatcatgctggtgtctaaatgtgtggaacccaaaagaaatgaagttattttaattatttgactattataaccctttgaaaggattagtgacttttttgtaccctgaaaggcgtattgtaggtgttgctagctgccacacatggaccttcaaattttcatatgtagcaactgtgagaacaaaagggtgtgtatatgtacacacacacacacacacacacacacacatagtatattcagacatttcacatttatatgagtcaatcttcacttccataaggttagcctattaaaatgaaaaataagaaaaatgaaaaattagctcaaacatttataaacagttttctaatgagattcaattttattattttaccaatttatttaaatgatatttaaaatcacttcgctacaatttttttttaatattttaagcaccattaacatcttttatagtctcttatttggctttgtctttctaacttaccaggaaaaaatgacttgcctgctttcttgttatcattttaatatatgttataagtaaaatataacagtacccatggcaaaattagaataaaaatagtaccaactagagtgtgatgctccatgcttttttatataatacaaatgactttgaatgtttcattcattatgattttaaagtggatgttcgttatgctaaatcttaaagaagcttgtgatggtaaaagagtgtctcttgactaggtaaactagtctcctaagtgggcactggcttattaccacttgaaaagaagcaataattattttctccttttagttatttacgaggatgagattaaagcttggatatgcttcctttatcctctgccttttcgcctagaatactactaagttgtgggaacagcgactgtttgacaataatatccagttctaataagagaagtgtcctcagtttcctaacattatacgtatataaattctctccctaggcacatagtaatttatattactcatataattggtaattactctatgataatatattacctcttttagggaagtagaatgatttaaagtagttataatctgtcaaagttattatacttaattctcgggaaatattttagttctgttgtaaagaactaataaagaaaaatatattttttacattttgtactgattttacttgcaaaacagactaaattttactttgttccttttttctttcaaagcacctagaaagtatgtaggggcaggaattatttctagagaagttaacacgattggagaataatttaccgatgatctaaaactaaatagaattaagggcacttgaatctcagcttagcactctttctaataaaatactgtgttcctattgaaacttaaattcatttcttcttgggaacaaatacattagaggacagagtatgaacagcctgtgacctgcttccgaaacagttgattcatataacagtgttgttgttattattttccctattatattgtctttagaactattagtatacttttggattctgcatcttcagttgtctagtcactttttattttttctgagacagggtctcactctgttgtccaggctggagtgcactggcaagatcatggtgagagacaggactagctggatttcctaggccgacgagtaatccctaagcctagctgggaaagtgaccgcatccacctttaaacacggggcttgcaacttagctcacacccgatcaatcaggtagtaaagagagctcactaaaatgctaattaggcaaaaacaggaggttaaaaaaaatagccaatcatctatcgcctgagagcacagagggagggacaatgatggggatataaacccaggcattccagctggcaatggcaaccccctttgggtcccctcccattttatgggagctctgttttcactctattaaatcttgctactgcacactcttctggtccatgtttgttacggcctgagctgagctttcactcgccatccaccactgctgtttgccgccgtcgcagacccgccgctgacttccacccctccagatccggcagggtgtctgctgcgctcctgatccagcgaggcacccattgccgctcccgatcgggctaaaggcttgccattgttcctgcatggctagtgcccggattcgtcctaatcgagctgaacactagttgctgggttccacggttctcttctgtgacccatggcttctgttagaactgtaagactcactgcatggcccaagattccattccttggaatccatgaggccaagaaccccaggtcagagaacaagaggcttgccaccatcttggaagtggccggccaccatcttaggagctctaagaacaaggacccccagtaacaatggctcactgcagcctcagcctcccgggctcaggtgatcttctcattttaaaaagctggggagaaacctaatgataaatcacagaatagaattgttgtgtttattttattggcatgtttacatgatgcagccacatattaatttgtatttgaaaccctttagttttattttgtgaataatgtttgcttaaccaaaaataaattgccaataaagaaaagaaaagaaagaaacatgacttgtacatttgaagcactgaaaaagtcaaaccctagtgcctagggccgcagatcttcacctccactttgcagtatctcaaaatatatctactttacggtcatttaactaaaacctcctctgaaactgagctttcggtggggtagtcttttgtgaaatggtgtgtgcagttcatgtgcgttctcatttgcctttgtccttaggggaatgaaatgcttcagaagaacactttgtaccattttgtgttaaggttgatcttttctcatcatttggagactttctctgctttgtgatagtgtcgaacctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaatacaaaaattagctgggcatggtggtgtgcacctgtagtcccagctactcgggacgctgaggtgggaggattacctcagcctggggaagttgaggttacaatgagctgtgatggtgccactgcactccagcctgggcaacagagtgagactctatcttaaaaaacaaaacaaaaccaaacaaacaaacaaaaacaaacacattcaattgccttgacacattcaattgccttgtcttattcattctcaagccatccaaaatccctgggttttgaacaaaataaatttgccataaaattgtgctagtaactagtgtctggacatacctaacagccagttgatatgcagtctttgttataatcttagagggaaagtgtggcccagacagtataaatatttgaaccagctcattcctctatttagaactatcacagtattatgaagcacagtatcttgattgagtatgagctctggacacagagcacgtaggttcaaatcccagctctgctacttattagttatgtcagcttgggcatgcgtcttcacttctcagtgcccccgtttcctcaattgtgaagattaaatgagttaatgcatataaagcactttgaacaatgcctggcacgtggtaaatccacaacaaagttagccattaatattaaggtggacatggtgtgaaaaaatggaaaccagtttacagtattctaaaaaatctctcaaattagttttgtttctatgactagttttgtttttaaaattagtttatgttttatgactactttcatgatattaatagaaaatataattttacaggggcctcaacctggtgtctaaatgtgtatcaacaattgtctcatgccaagtaacatgagctaaagctgtatatacaatatctgcagcttattcataagtgatctgaattagttaacatgaaaaggatcatttgaccttatatgcaagagtctagtataccaagtcaatgcaatacatgaaacaatgtaaaaccaaattaatagtctagttatctttagtagaaaaatgagtgtaaaagattagcacactgatgttttacactacctagtttctttcgctctatccactttgtcaaaatctttgagaatggaatttgatttaccttatataacagacataaactgacttatttttttttcagaaagatgttttctgaagttttctaattttatcttgattttgagggaaagcacaatggagctagagtagatttattttatttatttttcttcaccaaaataaggattccgctaattaaaaggcactgactagaatatcaccatggcctgaatgaccccagaaatcttttcgtgcttaatagaaaggatgcacatttttaatgaacactacatccttagacatgtactgctcttctaataagtcttgttccagctgtttaaattgactaagggagtacagttcatagattttgaagctaactaattaactctctgttctttgctttatttttttcttgttttgggtgtggagatatgcatcctttggcagtggtcatatttcaacttcttctctgtaaggccatgagacatttatggttgaggcattgatttattttaaagcaaaaagcctccctttatcactattttctttaaccccatttctagttacattgtttgtggagggccttgtttagttctttaaatattgggaacagtttcatcatcattaaatattaactgctcactggaagcagaagctgagcttaattaaggttgcagtatttactaaattagactgggagaggaacattttaagacacacacatatatgaaagagagagagagagaaagaaaaataaatattttacagtaatctcagcagtttcattagagctttgtcaattgtgttcgcatatctgaaacatttcatcccaaaatgaaagttacattttggatgaaacttaacatacttggtagatattcaggccaggcagaatagatctttatttttagaagagaaagcatttgtatcaataccttgttttcatgtctgtagaacaaaaacaaacagtaagttggcctaattttcagatgctttttaaaagaatcacttggctaaaaatgccacttaaatacacgatacatttagagtttggaattttccctgggcatatgcctgatactctaaattacatacaattatattttatttgtaattgataattattatgggaacataacagttgtgcatatttgtgggatacatgtgatattttgatacaggcatacaatgtgtaatgatcaaatcagggtaattgggatatctatcacctcaaacctttatcatttcttcgtgttaggaacattccaatcctactcttttagttattttaaaatatacaataaattgttattaactatagtcaccctattgtgctactgaatactagaccttattccttctacgtaattgtattttgtacccattaaccatcccctctttataaaccccttctcactaccctttctagcctctggcaatgatcattccactctctatctccatgagttgagtgggttttttgttttgttttgttttgttttgttttgttttagctctcgcatattagtgagaaacgtgcagtattgatctttctgtgcctggcgtatttcacttaacataatgttctccacttccaatcatgctgttgcaaatgacagaattttgttcttctttatggttgaataatattcaattgtgtatatgtaccacatgttctttatccattcttccattgatggaaacttaaattgattccatatctcggccattgtgaataatgctgtaataaacacaggggtgcatctctttgaaatactgttttcctttaggatagatacccagcagtgggattgctggatcatatcatagttctatttttagttttttggagaacctccatactgttttttttttatatatatagtggctgtgctaatttacattcttaccaacagttgcctactttcctacaattttaataacaagttagcacaaaggtttcaatagaacttttggtgatgaaatgtatattttccctaacaaaatataaacttagtccatgcctcaaaagtattttaatggcagtccatgtcaccaagtaaaaactttctgcatggaaattccatttttggtgttaggttggtagtagggtaggagtgtgaggaaaatgcttattctgaagtggagacatttgacctcattgggggattgaaacataatttcacactgattaattcaccctgtaaacaatcattttggtacaatgttttacatttctttatctgaaagaagattcatgtttaacaaaagaggaactgattttcatctttgtaccgctaatttcaaaatgcagaggtaaatcaatagccatatctaccctttatataaagtttgagtggagagatatgtggctggttataaagacataattatttaatttattctgagcagcacactgagccctgcaaagataaattgtttaaatctgaacaataatcagtgcctttctcaccttatactcttcatatacatttgtaagatatttttgcaaattaaattcttctttgaaacttttcattttacttagagacaggaaatttaattttaccaagtggaaaccccaaggtttaaggttagtgcaaaactaaaaccatttggaattgaggagattgcccaataccttctgacttcccaggtttcagtacagcgaaaactcacttgagacccttaagtcatggaaagcctaaaataattagcatggtttcaaggggcagaagtcacaatgtaggaaagccagttaggcagagaaggcttgacgttcttatttcagaagttccttgactaaagccttcaaatgaaagaagaaagccacggcaaccatttggaaagatctgacgaaacttacagctttgaaaaggggtgttgggaaggtgattgtgggatgttactttgcaatcataggaaaatatccatcttgttagcttttgggagatcagggatgggcaaaaatggcatttcaacagaagagccatttttggggagttcactctatttttctatttaagagaaatcaaaatgaaaatactaaggaaaacttgacctgtaaaacaccatacaacttggttgaagctttagtttctttacctatagaatgaggaagttggattagatcagtattttcctaagggtgtactaaagagagatgttaacgggaatatgatgaaaaaaggggggatggtttgtgagttaaacaatgttgggaaatgctgggttaacaaaggtaaccaggtttctttactttaggacatgtgagagcctttatcatactcttgtgtattgtcagcctacaagagaggaatataaagtgacatttcttatacccgattgaccagtgaacccagcttttgaggttcctctcttgggattagttgtctgtggtacacactctggcaaatgctggactaaatgatctctaagagcctttccagctttactatttgatctttctatgatatgcccataaacatataaacttccccagagcagtacaattttactatttctgaccttactaattcttaatctttgatcattccaatgaaagagtctgcattcttaatgaaaaaataaatttaggactgtgtctagcaattgcttaaatgttcacaattgtaatgtgaggctattgtggattgccatttttctcgaatatattatttggttcattagaattagccatacctctctactttgtgctctcttttaatgtgagtaatcagggattgactgaaaaagatatctatgcaaataatggctattcatctgcatgctgtgaatctgtacctttatagcgcttatgtgtgcatatagaaacatgtgctaagtagttatttccctgcactttaatgattgacttttactcgaatttgagtattccaaagacagggctgaaggaaaaaaagaaaagattaaccacccctcacctctgcacacataaataaaaaccttaaaaaacttaaaagcctcatctttatgtaacacctcatatactcaaaaatctgttctgtaaattcggagttacgggtttaggcaggtattggtcacacaccatccccctcttcatcctagcctaaagggggagctccagcagacatcgagggtatttaaatatactgttgcgccaccggtgggtgggaaggtggagtggctgccagggtagcgagccgtgtgaagcttttggtgggaggagctatggatcaaaaattgctgtctccaacagtcaacttccttaaatttccttgcagctgatcaggtaagctggggctgagagtgtcttctactttactctgggcaaatgaaggcctgggagagcctgggctgattccatggagagggcttctaagaatcttaaggtaaagaggtaaaatgggttttcaaggatttgcctttattgagctcaacttatcaaggcagaagaacagagcgggagagggctgccagataacatattgtatggggcatacttatactaaaaaattttttttcactgtttatctgaaattcaaatttacctgggagtcctgcatatttatttgataaacctggcatctctagagaggatcctaagcagaagccctagctggggaataaagggggcaagcagctggtaccctctttgtcctggcttctaaatcgttgtggcaagtgagtggatggggtgtccagaaaaaggaggtaaagaagcctaggagcaggagatttgactaatgggtcagagagaaacacctccttatgttctttcttaatgaagtccatgtagaaggagctttttgaagttatatgattttctgtgtgttttatttcttagagtaacaaattcagtaccattactttttctctccctttttttccattcttgatgacattttatgttggcagctatcagctgctctaaagacagcgtctagtaatactttgcatgaggaatgccttctgacttttgataacttggtaccaatgtgcttcgttgtgtttgggttttaattttattctggttggctggtttgtaaatagatgatgcatttttgaagagcttataattgaccagtcattcagttaatatttttctacagtgatgtacggtattcgatgagaaccgaggtaaaaagtgtgtaagtggggtggaatagggcaggaagtagatttgggttattagtgaggcaggcttgctttcactgtgaacaacttctgggatttttagtgttatttgctgttcaaaaaatttctaagaaaaagatcaagctcatgatcatttgaaaataaatgtttaacgtaaacaaagctaagcgtgggtcatgaaggaaagccgcaaacatttttcttgtaagaaggcatatgcattagagagccacaagaaggccccacctgctgtgattttcctaaagccacctttgtcttagtagcttcagggaatttgacttgcggcttgttcagagaaattcaggatggggggtggggcagttggagaacgcagtttttttctaaactgaccctggaaatgcagggccctcctgggcaggcccaggtgctgattagatatggatctgctgctggctcctttattcgtccggtggggccctatatcctgagggcctttgtggccagagaccccttggaatcagaccagagtttctgtctctgggtctcatggattcatgtcacttctggttaagttatactaaattaccaggatgtttcagccgtaatggtcacatattcctcagggtctatattcataggaaaaaaaaaagttaggaactagctattttctggacctgaatagaataacggttcatttggaacagacaaccaggggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattctaagaggaagaaagtgggaaatttgccagtagaatgccgatatctggctaataactcgttgtatgttgatcttgactcaggtttttcctagctttaataaatctgtgatgcttgcaggaactagccaaactggtacatatgatttgtaattctgaaatcactgttacttcctctgagaagccatgtctgtgcatgtaagtatgttacagtggggcactatcatcagaattatttcatttaatccattatgattaaaatggaataacaacatttttcttcatagaacaaatcatctcttgggtgccttgatttaacatttaacttttaactgttggcagtctagcagatcagtgagattatgtatttgaaaagtaatccagttataattgtatttgagagaacatatttaggattttttttttctctctaactctgtatgtatttgaagaagcaagtcattctgcaaacagctgtttctcttaagatactgtggctgacaaagggtaatttgcagcctcccaggttccttttcttattctgatgtatggtagggctttttctcatgaacatgaagtacatttcacagggtttttctaccacccagtgcatgggaagtcttgtgacagactctgactctcataactctctagacataggtgggatttgaatctctacaatgagacttttctctcttagttaaaggctttgtattcatttgggagaagcctgaaggtaggaagaaggcaatagattgaatttgggaggctttataaatgttctgcaatgtatccctttgtctgtcatcaacttcttgatgcagatgtacttcagaaatgtcatcggctattttctccccctgcttgctgctttttgagtgcatttttcaaagacagtcgatgggaaaggggagctggaagattcatatgattcataggtgtagtagcacttatttcagcagagaatcgctttcctattgaatcactttgctattttcttaactcagtaacacagtgaaagaccagatgagaatgacatgttttttaagtccaaaaggaaatggaaaaggagggaaattgaggcaagcataaatgagcttgcactctaatcgcttcaacgtttctttaattttgagtgtatatgggagggggagagagagagagttgattttcatgtcttgactccccttagctgctgattttagtacgtagcctgctctgccagaggatggcgactgttgtaggtacgtttacagagtcgtttaaggcatgctctgatactttgcactagtgtgagccaactctgaacctgtgggtctagattggaagaaggagggcttgggacaccattgacttggctagggaaacatgaagggtgatttttcagagccaagatggctgctgggctatcacaccaaactgttatagacccaatgtgatagggtaccttgtggcccactcagagtgcttaggtggcctacagaaatcattggaaccttcctagtacagagtcattgattttccaaaggacaaaaacaatagatgattacctactccactgggacagtccctccctaatccccactctatcccaaccttacatgctttaccaaagccttaattctatacaaggattaaaaaacaagtgttaacagatgtaaaaaaaacaagtttgttctctcccaaacaccaattaaagtattttggcctataattacgtttgggcctcttgaagaatgaacgctatgtagaggagatttattatcaccaagtgttgtgtgtacaaatatattatcctgagttctaaagtcgttttgaaaaaacaggggcatagttttcttttgaaatgttgtattgcacggataatatagatgttaaattacttggtctcctcatctattgtttggatagagaatacagatttttattttattttataagctttctggaacataagcagcagtctctggtaagatggtgttgctatgcatttgcattgttatagaattaaattatggattcggtcattcaaaatagaagctttataaatcaagtaaaatctcataactaagatgaataagtttctttaagtctcatgctgcctcatattccatactttagttttatagcccaacttgatataattttttaaagtgtaattctctttttttctatttctgtgtactgtttttgctctgctaaactgtcattatttcccaagaaaaagcttaagataagttactttatgtaaaggatagtgatataaaagcacaaaggcatgttcacttctttatctgtatattggcaggaaatgtgccaaatacagtgtgttctctccctccctttcttcttctctctctgattacattcaatgtagatgatattaaaactcaattgtaacaaatggtgaaattccaattattcttttttctttttttaacttatctaatgtctggaattcctgaatatgaaagacagtcttcattatatagttgttttggagttaaaaattgtgttccacgcttgtgtatgctaattgtctaaacaagctatctaggtggctctgcaatccttaagcaatgctgctgagctgcataatttattttccccactactgctgtctaactaccccaaagcataggaattagagtggtggccctaactgggagtatgcagtaagatgaaaaatagtcaaatgagaaggaaggtcagtaataagttatttagacctggttaggcagcagggtctccaaatgcagctgcaattggtaaaaaaaaaaaaaaaaaaaaaaaaaaaaaaaaaaaaaaaaaaaaaaaaaaaaagactgaaattcagaagagaggtcaggggtagagatagagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgcttcacattggtgggtgtaaaaagaagcttatggtctctcttaggggtacatttatggggaaaagaccccaattattgtgatttagcacacacaggggtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtctccggaacctaaagaacaaaatggctgccgggcatagggatttattatttcattaacagactgtcagtgaatttcagggtgtttctcgccttatatggattcaagatgaagagttttggagcttagattgtccccagataatggagtccaaaatttatctatttgtgtatagttttaatttaatattttccctattcttcattgtcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttgtaagtcgcagctatattttgaaaattgccgataaagatcaacagtggaataacctggcagggacttggggaaattagttgcaacaggatttaggacacaaactaatatgttcattgacactacagagctgtgcacttgaagagagcagtcaggtgtgttgcactgaaaacctggctgcatgagttcactttataaaagaatatggataaaggagcaggggcattttaagataaggagagttgattattattacatggaaacctttgaattctaggacattaattcaaacaaattttcttgttctttgatgggggttttgttgctttttttttttttttttttttttggtgagacagagtttcactcttgttgcccaggctggagtgcaatggtgcgatctaggctcattgcaacttctgcctcccgagttcaagcaattctcctgcctcagcctcccaagtagctggtattacaggtgcccgccatcacgcccagctaatttttttgtgtatttttagtagacatggagtttcaccatgtccaggctggtctcaaacgcctgacttcaggtgatccacctgtctcggcctcccaaagtgctggaattacaggcgtgagcccggcctgttgttgcttttaaataaacgttttattttgaaataattttagatttacagaaaagttacaaaggtattaatagtacaaagagttcctgtattacctttcacccagttctccccactgttaacatcttatattaccctggtagatttgtcaaaagcaagaaactggaatcacacatcattattattaactaaactccagactttattcagatttccccaggttttctattaatgtaatctttctattccagtgtctgattcagggtaccacagtgcattcatttgaattttgcctcccctctcttctctgctctgtgaccatttctcagtttttcccaatttcccatgatcttgatagtggctttcccttaacttagctacagggtttccctatgcagaaattagtaagattatgtcattctagactaatatctactattttctggacttgcaagtttaaatggatcctttataaagtaattaagctatatctgttcatattgttctattgaaaattcatcttgccctatgccttaaaatataaactttcattttgcttttacacctcttagggagaattgaaaactgtcccttttctgctgtagttcttcaggcctcacatttagctcagtggtgcctcattctaattccagctggcctacttcctttaaactattaacaggataaatttgaaaatcctgttttacctttatttgttacccatttaatcagtgatacaatgaacatattgaaagttgaaatatgtatatagtatttagatgcaatgaaaatgggggaggacaatcagctgtcagtaaagcctatctcattataaagttaattctcagaattcaaggatatctgtgttgatatggaaccctttaatgagtacatctttatggataaatgcaaaaacagatgggagaggcaatgatgaatcactaaaggtttgcaccatactctttttccagaatgtctagacagatttaagtaaaataaatagatgtcatgttctgtactattagtttaccaaaaagttttgccttggaactcagattaattatgttggtaaattagttcctagaaggtgaactcctcaaagctcctctttgaccctcagtaattctttacatcgttgaactccttgcgcaaacgctttttctgggctttcacatactgacgtatctcagtccctccctacttctaagggcagagggaagataaagtcttttggatactgaaaattgttatgaacaaaaccacagagaagtgatcgtgcttggtaagtccagaaaatgtgagtgggtggggaataaagcaaggcagcttctattttttcccccagctttattgaggtataattaataaataaaattgtgtatattttaaagtgtacagcgtgtgatgatttgttagacgtatacattgtgaaatgagatgacatggatgaacctggcaggcattatgtcaagtgaaataagccagacagagaaaaaacaaatactatatgatctcactcatatgtggaaccttgaaaaaactgaatgcatagaaacagagagtagaagggtagttgccaggggatgtgggtgggaggggatgggggaagatgttggtcaaaggtatagcaagggagattttaactcacaattattactctcagcttctcatgggatgtctcaatttcaaactgagcaaagaataggaagcagatttcattatcagacacctgagcccagtggttcctacagagctggagcatttatcttttcaaaggtcgagggatagcttcagggtactagtgaaatgccttgtttcagggaatcagagagcaagaagtggggtaaagtaggggtacagagggaagccgttctattcagcctctgctagagtctctccattccaagtctcaacccttcaagtgttattgatcgtgctggctcacactggagaatagggagtagcttttttgagaatccagtaagaaatccattgtgctttccagcctcttcacttgtgctttctaatttgattctctatgctttctatgttagaatatgtttccctatcttttcttcaatgagggtaatttcagatttcagatgacggaagatgactgctatgattcacaggagtacaatttattttatagaatgttacaagatacaaggcattacttagaagacccaagggaacaattggaaattgcttctctaccttgtagattatttaatgatagctgttatgatgcgatgagccgataaatgattaattcctgcagttattatgtgtacaaaaatctaactccgagatggttgatatgttcctcttctatggtctaaggaagccactttgtagacatggtgtaattgagctagtgtgagcaattttaagtaacatttaccagtctgatttggaaaaaaaatttctttattgtggatcctgatattattacagaagtaatatatgattttacttaatttctctggtacctactctccctcaaacaactctctatcccttttaatcacccctacccaataatctgattcttgtctctaagatagtcatacttttgtttaagaaatttccagtcctgatatttgtaaggttgcatattaagacccatttgtatgactggcttgaacttcatgtctttccacaaagaatactttgatctgtttctaggataccagaagagcacatctgcctttgcagaattgaatatggtttgcttattataagcccctagataaagggaatgtcaacctaaatgcgatggtacctagagaacagattctgttgagtgtgactgaacaatgaataaaagccacacctagtcaatttgggtggaatgcttgctggagcaggcaagtttgttcactctattaaacaggtctgaattgacatttgccagtataaaagtccatctctgaaagcttttttttggctttattaaggaagttcagcaggtgaaacaaaaggtgtgactccctagtatttttcaatgcagtttaagagagattgttcctgatgttcccagcaaaaaagtataagttgaagtatccccttgccataatcatgaggcaaatacaaccactgtagaagaatattagaaagagtaggcacagtggattaccctgaagcaaagctaatgttttaaaattttggttttacaattagaaattttagttatgaggaaagattctccctactgaatgtggtgtatgtatttataaagtgaatatgatattacaggctgttaaaatgttttatttggacattttgcatatctacacctgtccatatccaaactaaaggaaaacctgggaaattcccctagtttctctctttgaatgtggtgattcacatggaaacagatcctgacacacaggtgaacttgactcagtagagtgtattcatttgattatttatatagagattgttgattcagcacatttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcattttcataattctgtttaccaaatatatttctcataaacaggcttatatgtttatctaacattaatatagtaaggaacgaaggtgatgtaatgcttcagaaccaagagaaaaaaaataatagaaagttcaaataggtacgaggaagggagatatactaattaatgaatattatttttagactcatgtttttaatgttgtttttttctcttttactaaagggctacaatgtattatattacttgggtttatattacttataaacttaggactagaacaattttaagtgactggagataaaattggaaaatatttatttactttttaatttttttttttttttgagacacggtatcactctgtggaccaggctggagtgcagtggcatgatcatagctcaatgtagctgcagacttgtggggtcaagtcatcatcctgccccatcctcctgagtagctgggactacaggtgcacatcaccatgcacagtaatgttttttaaaaattttttgaatagaaatagaaatgtgatctcactatgttgcccagtctggtactgatttcccagcctcaagcaatcctcctgccttgacctcccaaagtgctggcatgcctggcctactttttaatttttgtaagtcagtcattaaatgatatagtacttgaaaacaagaggacaaatattcatattagacttacagttttttagttcacataaatttagtttattgactgaaatatttatgctataaaaaagagtagttttgtcatggctcttttattaacaattattattttaaaaggtgacccagacattatgtaggtttaatagaaaagaaaattatgtccatattctaaattaccagtctcatggtcagtacagaaattataacattttaatgaaggttctgcagcaggtttttcagttcacctactcatgtaatgatgaatgatggcatttagttctttcatcttgatgtggtgacattacatgttttgtaaatgatttttgcaaaattttcaagttaggaaagacaagcattatgtaattataaggttaatatgctcttaatataattacaacagtcatgatcatgtgaacttccgcattgaggttgaccaaatcatatcacagaagtgcctggagtgctaccatgccatgatcatctggattttactacattttctgaaagattagacaaaattttacttttaggtatatcaactgaagcctactgtaatctgtttgttcaactaacattgtttttaaggtgtacttaccctgagactaacatgaggggtttagggatgctcatttgcatggtttccttccaaaaccctgagaggggtcctagcaacgtgtttaaaatgtgtttgtaaaatttgcaaaatatattcgtgtgtttcattcttaaggctccacttccccacccagtggtctaagcttcagaccccacatatcctagatttgctcctcattgcaattactggtccaaagtagagtagttattcgggccttttgctaataagactgtgtatgtcacatagcttaaagcttcttttacgttaaaacaaaataaatcccctagcagtccctttgctgctttgccccatctctgttaatagacactgtgaaatctgcttttttcaaaagttgaatgaaaatgctacacttttgcagccaaacagaggacacttgtacatgatatcttctttattttattttattattattatactttaagttttagggtacatgtgcacaatgtgcaggttagttacatatgtatacatgtgccatgctggtgtgctgcacccattaactcatcatttagcattaggtatatcttctatagtgtccagtttctttgatagtcacaaatctcaacattctccctttatcatcctttatatattcccgtgagataaattacatgtaacctcctctattttgtgtccttctcctctggggctggttagctcagttagttggagcctggtgctaatgagaccatggtggcctgtgagcttcactgttcgtggtcacagtgtaagctacagccagctaccttgagattgcttgctgttgatcacaaatgaggtgaaggctgggagtttggtgggctctgtgaatttttttttttttttttacctgcaggttggtatggctcagtaatttgtcaatgagaggagaccttatataaaaacctgtggctgccctaccacctgataattaaagtggtacccccaagcatttctaatttgccttaatatcctgtaatcatctgttaaatattcatttacacccttctttccgtggtcttctctcttgaaccactctggataccagtcacattagcaattcattaatcacctggattatacacattgtgaattactttgtgtataaaaaggtgtgaattactttgtgtattacaaagtgtataaaaaattactttttatacactttgtaataaagttacatatttttatctatagtatcactaaatcacttttttttagaactcttaattaggtaccttctagtatggatttagccactccaattttaaaaatacatacacatatgggattcatgtatgtacatatgtacatatgtatgtataaaataccctgtgcttttcatactgtttgatctagcaattcatatctttatcaaaagacagcttaggactagccatctgcctaaagtcttcctcagtggagaacaagactgaaggatttattcaatttctttgccaccatttttgaaactacttttacttctttttgcactctgatttttaaattgggttgatctatttagtaaatcaaaaattaattaatggtttaggaatccctttttattgaattcagtaagtattgagcatatactctgtgacaggtatttaaatgagtaaagggtggataaaaagatgatcaagaaacaaactctaccctctaggaattcgttatgtaacaaaagtaagatgttggatgaatattttctggtccccttaatttctgatttgtacctgattcttcatatttttgtagctttgggcctttcttttttcaacatagaattatctttctattagccatgcaaggttctgttttggtttgtgttgttttgatggtggtggtggtggtggttgtggttggtcaaacccttgataattttaaactcttagcctacctatttatctaactttcactgacatgttcataaatagtctccaggtttcctgtgggttccttgctttgctcagttcttcctatttatctcccaaaaacccacattttgtttataccctttgttaaaactagataaccacttaattctttgaactacttcaatgaggtatgattgacacacaaaagctgcacatgttcaatgtatacaaattgatgactttggagacaaacagatgctcatgatactattactacaatccatgccacaaacttgattttttaaaaaataatctttgtttcctactagaatactaaagttaattgaattgccattattattacacggtggtcaccaacaaatttttaggtcaattcctgttcacctcctcaggaacaatgtcaaagttaccctgcttataagtgtcaatcatttgctctcttcctaggtgatgtgctgatctgtgtttaggtactcctttatgattcctggcctgctgttgtatttctcctcccagcaaatatgggtagctctgaaccatgacttgtgttctcatttgtgttattctttatacctcttatactcacaatcacctattgatctttcaactaacctgcctgccttcaatggttcctcttacttggagaattctctgattaataagatcagaaaatccaggtctaggtgaggacaatggttcacttttgacccatgaactttttttttcttagctctctctagagccatggggacttattcattaacaagtacgattagtacttaaacaccactatcagcttgcatctgtttttaaagttaactctcaattattgagaaactaattaactagtctggaggttatgtgggtctcctgcagcctgcattttggccacttcagtccccacggaacattactcaaggagtgtggaaatgaccaagcaaatactgtgaaagagagattattcaattgtactctgtgtgaaagtgaagtctgatggaaactaaaattatggatttcagtgcattttgggattatctaaagatagaaatatgcatgatgaccgtaaaaagagccttccttttatattatataaatgcttgcaaatgagcaataaaatgaagatattatgacgctagtaaaatttatgagtgctatttttcttgtattaaaattgggtcaacaaattgttaccaaatgtttacccttctgtaaaagaaaatatctagtcattcaactctagacaggaactcagagatggaaggccccgattattctgttgaccttaggccaggattttgaaatattttacattcatccaacaataattgtaattgatcttggatatttttgaggtaactacaaatagatctaggctattgaggagacacaaagattgatttggcataacatttaattttcatttatttatactagcttgagaaataacctgttaagtcactgttcctaaagtgtgtgtaaactagacatttatttgaggcatagttttgcattgaattgcattgcctcagaatcctttaagagcaatctgtggtggcttttaaaatttttacctttacaggattccaactactatttccccattcttagtcacggagtagtgattgttctataaacaaatagttaaaaatcctaatcctaatattagtaactatgtaaaagaacattttagtgaataccttagtattggtttacaaagccaaacattttcaatttgtggaatcttgctacaaatactaaattcatatacatatatattcatatatattcatatatatatgaatatatatgaatatatatatgaatgtatatatgaatatatatgtatatatgtatatatgaatatatatatgaatatatatgtatatatgaatatatatatgaatatatatgtatatatgaatatatatatgaatatatatatgtatatatgaatatatatgaatatatatatgaatatatatatgtatatatgaatatatatatgaatatatatatatatgaatatatatatgaatatatatgaatatatatatgaatatatatatgaatatatatatatgaatatatatatgtgaatatatatgtgaatatatatatgtgaatatatatgaatatatatatgaatatatataggaatatatataggaatatatataggaatatatataggaatatatataggaatatataggaatatatatatgaatatatatatgaatatatatgaatatatataggaatatatataggaatatatatgaatatatataggaatatatatataggaatatatatgaatatatataggaatatatatataggaatatatatgaatatatataggaatatatatatgaatatatatgaatatatataggaatatatatatatgaatatatatgaatatatatgaatatatatttggtgctttactcctgaaagcgttggagaatttcattttttgaaatcatttagaaccaaggtcggtgaactttcttgtgaatggctaaatataaatattttaggctgtgaggttcaagatgcaaagttgagggtattatataggtacttatataacaagagaggaaacaaatatctacaattttttgtaatacagctctactaatgagcacaatgaaatttgtggatggacactggaataagagtttcctataattttcatgtttcactaaatattattctcttatttttttcaatcatttaaaactgtaaaaaacattcttagattgctggccatacaaaaacacaggcaggctgaatttggcttatgggccctagtttgcagagccttactctagaacagagattcttaaccagtaagtagttcataaccccacaccaggggtgagtgtcgtggggtccttgaacttgctgagatcacaagcaacattttttgcatacatgaatttttctgtggacagagtctgcagcctttatctgactcttggagaagtcctggactcaaaaaagattaggagccagtgttgtctagatatttcgttaatttttaggacacatttcctgagtgtctgatagttcctaagcaatctgcaagtcactgggaactcatgggaatttctactgtaggagctaatactgctagagacatggggataaatagttgtcaggtgatcttattcataaagtctgttgccaccaccattcttgctggttgacaacactcagaaagatgaaaatttacacctggttatgggagggacagccgtctcttttcaagtatttagtaaataatttaggttggaatttaaatatctgaaacatttaagtgttcagaccatttcaggctgtaaagataaatcagagtcagtatagttaaaaccttttcctttacaataaaaattaacccacagataggttcatgttagctcaactgacatcaagggctgagatatatatagagacaggattaaagttgcttattaaagctgagcttctgagcttgcaggctgcttgacttaacccatggctgttagtcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagattcgggggttttttcaagtgaaaaaattttataaagcaagaaggaacacatgcaattagtaatacacaatgagacaccaccagtttcacaataactaacttgtagagtcattattagaaatatactacatttagtcatgatttattattcattcattaagcttttaaaatgtatcattgagtatatctgtcaaccagtcattcactaagtgttgggtactataggggagatgagaactatcaaaggaataaaaccacattgacaagaaaagatacccacatgtggaacaaactggaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataactaaaagagtataattagagtgtttgtgacaccaaggaatgataaatgcttgaggtgatagatactccatttaccctgatgtgattattacacacagtatgcctgtatcaaaatatctcatgtaccctataaatatagatacctactatgtacacataaaaatttaaaaaacaggacctctgatttaaaaaaataacaaaatataatggaccatactaaactcattttaggtagatattaaagcactcactttttctaatttatcactttcttcctcaactccttgctgtgttccataattgtcagtgggccaggaagacagaagcacagccagtatttggtagtacaggtggggcctgtggtaggacaggcagccttacagccaagcagtattgatggtgaagaggaaagaggaaggaaagggactgaatgcaaaggccatgcctgtgtaaggaaacaaagaagattgtccatatgtgtaatgtcattggtgacatggtttttagggaataaagaaagagttggaggaaacacatttggaacagactagcagtgagatttaatttggataattcatgactgttaaaatcatgtggcttattttatgagcttaccaataaagttagtacgtaaagagatttgttggtttaaaagcaactcctctatgggaattagtatgaggctaaaaataaatcagaagaaaacaatagtaaattttgatgtggcataagtaattttgatgtttctgaaagaatacctctttgtgtaatgacaggaagaatctttacctctaacatctttttttctcttttaaacatacagggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggtaagaaaaggcctgcacttgtggcctgtttcagagtaaatgctttgtatattcctcaatttgtctaatatcctgtaaccatactcatggatggtcatgagaggaccttaatatgaacagtcaaggttataagctggaaaagaaagaacctatttattctactttatttactaagattttctaaagataattatttaaaagccttactaatgcttttaacctactgtgctctttctcccattttcagagtaagggtaaattatataatttaaacagtaagttatttttgagtgcttttatagtttcactaccctcaatatcctagagaggcagaaagttgcctctgctctgtgagccactttcatgggccctttgctactaacatccttaatgcctttcaaaaacacagcacttaaaagatagggtattaagtaggttgtaatttcctaaaggttaaggccacttttcctctctagaggcatagtatcaaggacagcagcctgcttagtctggggggaaatttctacgtggttgggagcagaggcctgactttggttttttttttttttttttttttttttgttgttgttgttgttttgttttgttttgttttgtgggggtggttgtgtgttttttgttgttgttgtttgttttgagatggagtctcactctgttgcccaggctagggtgcagtggcgtgatctcagctcactgtaacctccgcctcccaggttcaagcaattctctagccttagcctcctgagtagctgggactagaggcgtgcaccactgcttctggctaatttttgtagtttttatagaggccgggtttcaccatgttggccaggctggtcttgaacttctgatctcaggtgatcctcctgcctcaacctcccaaagtgctgggattacaggcatgagctaccgtgcgcagcccagagtcctgacttttaagttgctgtagaaagccagttttgggggaacagttagtgctgcttagtaatactgaaaggtaggaagcaggaaaaatatttgtgtaacactgcagtgtgatcactgagaaccaggaattctcgtgacttaagtttgccacagctgtccgttgttttgatgtgctgcttgctatgtctttctttttctccctggacctttccttgtgtaataaggcataacagccccagtaaaggacaaaacccacaggaaacctcatgttccctgggtgtggaaaaagcactgacatgaccctgaagcccaggagatgcactgtgagctaaatctcctcacaaacattcatagtttggactcccatgacagagactttgcctattcacaacagagagacacttattttcaaacatccctattaagaaggttttcctcataccgagttgaaatttatcttgctgcaactggaacttcacaaaagaagtcagtccctattccaagtgagagtgactctcatgtctcctgtctaagccaaatactgcaaattgctcccttttcctggtagtttatggtttcaaggacacagtaccatttttggactggctccactttttgtcagaactgaactcattacatcgtgaaggatctgagcaccaaagtagaacaaacttactttctcccttgatctgaacaacataatctgttaatgaatgttaaaaaagactttaccaaattctttttgtcttaaatgcttttgaaggggtaattataagctatgaaaatagcttcatatgcatctgtccatttctgattatttgagtgtgtttgatagaatgcataggttacaagtcagcctcaaatttccacgtagagagctaaatattatatcataggccttcaattgttacttgtgaatatcaatataaaattcccttttaagtaactgatcacagcagggtcttagcagtgagatcaagttggctcataagaatttgatagaggtaagattaaataaaggagggcttcatgaagaaattcaagctttttatatttttaaggattcatagtggacatgctttataaaagagacatttttaccttgttcatgtatatagctcaggttgagttcacagaaagcagcttgtatttaaaaaaaaaaagagagagacataaagggttgatacttagttcatccacagtctcacacctcttcggcaggtttatgagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaaaaaatgtaaagtaatgttaaacttctccaaagaatctgatccaggggcaagtttcacggagtattataagcacagtgggattttgaaagaactgtagacatgaaaggatggtttaaaaatgctaataggttttagaattaaaccttacaagaacttaacaaagcaaatggtacataccgaaatggacagcaagcctctataaataagaactgcatatattttgctaactatctacatagtacctgcgtgaggtaggtcgtgggggaggaaatattcatttgctttttccttacatgttagttaggaaatatataattataggacttgaacctgaagtctttgtataaactggattttattttatggggtgacagtgtcagactctgatctaccaacatctgttttatcacctatatgccatttatgtcctagatctgtattggagttttaacaggcagaaatctctttcctgctatatctgttgcttctgctaatctcatttttatagattcatagatgagtatccctgagatattaattataaatgattgtttactgtagtagctttctgtcatatcctgcccaaatgaggtctaaattagtgaagttgaaaacctttttttttttttgcatttttttttgttttgcactactgctcatgtagttggactacctctttttttttttttttttttcttgagacaggctcttgctctgtcactcaggctggagtgcagtggtgtggtctcagctcactgcagtcttgacgtcctgggctcaagcaatcctcctgtctcagcctcccaagtagctgggaccacaggcatgcaccaccatgcctggctactttttctattttttcagagatggggttttgccatattgcccgggctggtctcaaactcctaagctcaaacaatctgctggtctcagcctcccaaagtgctgggattacaggcgtgagccactgtacacggctgtgaacccccttatctctacatttggttaccttgctgtggggccactgcttatccagtgtcttgcccaatgcatacccttacggaggattcccaggaaataccttatatgactggtgcttgcttggtttgagtacatttgttactttctctagtactagtaccatctctccccccacaggccctgcagcctggtacactgcaactgataccaaagagatcagcactggaaaagcccaatggtgccaccccggtctttaatcccactgttttccactgccaacaggctctgactaacctgcagctcccacagccggcatttatccctgcaggtgagaacacagctctaggcactgcagcgagtttggtgatgttgtgaatgtatacaatgcaaaacagctttcaaagagcttgtataggaggactgtcgacatgtattttgattaaaaataaaacaaggaagttatgcttatctgctagtatctagaactacttgtttttctataattcatgaaaattcatggtttgaaatcaaactaggaaaaagtatcaacatttttctttttagcatttgttggtttttgcttatgattaattcacttggttcagtctcaaactaattccttgactcttaggtatcactgtcacagacagtagagtgctgtcaaataaaaaggcaaaaactcccagcttcgatattatggaaatgcgttgtcaatatgtctttgatatgccaaaggtagttaaaataaaactaccctaagtgcataatatagtataatatagattaaacagatagttttagcctgtaactcctgaatcagttaatataaaatacatagcagtttatattttctgacattttgcagcatattttgttatctcctacattcagctatatttaatagcctgttttacatgaaattgaacagaaaatgttaagccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttttaaaaaataatttagaaatccttgttaatacccagacttgagaaaacttattggttaactagtaaattaatcagttaattaattttgaaaggtaccataaaacaccagtctttagttactagccacagcagtccttcatgccatcatttaaattatacaatttgtatacatttatatgatagtttctgagaggaaatatggaattcttcagcactttcttacatcccttataataagtaactactgatatctaataatttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagcaacataaaagcctgtccagctaagaggtctctcttaatggaacctctttgccatatattcatagtcaagtcctattgactatgagacagtggaggagacagtgttaacagattaatactctaaatagaaacacggacaccagatacgagattctggagcatatttagaaaatgatatgtgtaataaattaaaattctcttattataaaaattatttaggatgtatttgtccacaataaatatgtaatttaagtgagttaattcttttaaagaaaaattatagctgattttgtacctaagaatccaagaattattttgattacctgggtttgtgaccttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaatatttgaaactagccagactgggcagttttgttctttgcttaacatgtattatttaaaaattgtaaaatacttaaaatgtataacttgtaaagtacaatgaaacaattcccacctgaaaaagttatctataggacttaaagcattcaatgttcctatgttgcgagaggatgagttcagcaaagccagaggattctgcagtgttctgtaatgaatcctgtagtgttctagcctgaagcaccattggcacagaagctaggcacaacagaatcatttcaaaatgactctttgagtgttacgtgatttttaacaagcagttgcacacagatccttttgttagccactaacacaatatgatagccatctctaaaccattttatacagcactaatactgaagagcatgagaaaggaatggggagttcacagctcctacagtcctcatgggcacaaggaacagaccaggagaaaatagctctgttctatgcaaggagaaatgatcccaacccgtcccactctaccgtctcacatcaatccaggccatcccctcccttttgagagtttgcaacaaattgacctttgtcaccttggtggaccagaatagatgcagagccccaaaagcactactaacaggcttcttgagaataaagttcaaaatgacaaccacatagtagcagcactcactaacatagcgagatctgaaccctgggaatggaagtgaggcccctgttactgagggtttgactgtcttctgtaggaattaataaacatttccattaataccaacaggagcacaatatgtatacctttgaatcataatgtgtacaattagaacagacttctgcaagtttgagaaatgtgtctttgccttcatgttttgtgacagttttcttgaagatgctctcttgtcctttcaccttcagagctttgcttaggaatgcaaactgcattctttagtggatctgcttcctgtacaattgctgcactcccaaagggaaaacaagagtgtttttagaattggcatatgagacaacagggatggctctgggtaatgggtaactagagataaatggaagggataactatggagtttctgttaatcaccatttggggtacattttcagtttctatgacattgcacatgttaatttttctctggccattcattttctctttagactttcagaaaatctgaatttaattgatgtagacatgataaattattacatatgcatgcttgccattcacacattgccattcacacattaattccctggtttgctttctgaaatgagctagacatcagaaagcacccaaaacgctttctaaatgagatagaaactagaaaaggcaaagataaaacatcctgcaagagatttcacagctgctaaccattgtagctataatagttgctgtgaagacaagatttactgtgaagtactccatgtatttgtttgataaatggccaaagtttcccaggagtttgccagaggtgtacttaaaaacctgcatgcatagtccactgtattcttcatatctgcccccctaccacataccaaccagtctacctaccatgtctttgcatgcagatcaggtaagtatacatataactgcctgtttgcacctgcaaatctagtgacggcattcatgtccataagtcagtgaacctaaattccaatttatgattccttaattccattttgaatgtgcagtccagttacttgtctgcttaactagcttcagatagatagcccttgtaacattggatttttgttttcatatgcattcattatagccccttctgaaaatttagccttttgagtaaactacaatgggattctgctcaaaaacttactaaatgttgagaatggttccattttccatattggtaactataattggctttccccttttctctttttaattttccccccttccatgctgtgttgctttgcactgactgtgattgcatgaacaccctgatgtattcatcgttatgatgtcacatggcttgttgctgtgatacctaccacacctcattccatcgtaaatgttatggttgcataaatcctctaccctcccgtgtgttgcttctatggttttcaactgaaagtgcccatgatgcacggtgctacacctaccactgtgtctgcagcaacaacacctgccaccagcgttccgttcgctgcaccaactacaggcaatcaggtttggccatttatttaagctgttcagatcaagataactacaatgttttggtaatgcacagtatatgctttttggattggtgagattcttatgtgtttcttaagccattgtcacatttagaatttttatttttgtgtatattctagaatgctatatgtgctttgctattcatcccaagatgaatcagaggagttttgctcatttttaattggttaccagatgttgctcttgatattctatatttaattactggtaacacaccaatcctcaaatgtatatacttaatgttacttaaatgcttcctcattggtcaagagaatttatttcactgccatttttgattattgtgtttaaactttggcttagtacagtcatcacctttaccttcagatccactggagagaaaacaaaatatcacatttctttccaagacatggatatccttatcatttcgcagtgattacatcagaagttccttctcatatggacattagatgtgcttgttgttttgatttttatttgctttaggtatttctaggcagagttcacaaggcagattataagtttggggggagtcttgaaattataaggagatacatacaataattattgtatagtattagggccattttgccttattaaagtgggaaccatgcttatagactaaaagatccacatatataacaacataaacagaattctcccaagaaactattttaatctaaaatcttttttactactatagataccccaattatcaatagatgaactgaatagcagcatgtttgtttcacagatgtagaagttctcagtagaacagtaagtttctttcagtattaatataaataatatttataggctacatattttatttacacaattgcacttctaaaaggctttcgtaaatattttcattcatagacattgcttgtgatgtagagcttgatttacacattataaattttccaaattgaaatgtgagtgcaaatatgcaatattttttatatggcaatgacagctggtactgtattttctcaatgagctaacacattcttaaatgttttcctattattaaaggaatatataatttgttagccagaggcacagattacttttgagttgtaattctttaaccattttatagcttcattttttttttgaagatcaaacaagaattttcaggatttgactgatatgattatgttaaacacagtaagcactatgcctgtcatgtgacattgtattgaattttgagtgacataatttagtaactgagtcattattttcattccaatcatgtctcttttttaaaatttttgttgttgtgggattttttttttctccttcaccctcaatctcctctttgcctggtgcccatcatggcacacacttttttaagcaatcattcacttaagaacatgtgatttctgaagccacttaagactcctaggtattttaattaattctagggacttactaaaatagtgtaccaactctgaattgcataccttcatcatcgaaagtttgaagttctcacacctggagtgtgtcatttggttgaaggaggcagcagttctgttccctcgtgaactagttccccagaccccagctagcccttctttcctgctgaggacacacgggcttagaacactaagtgttctggacagagcagatagccgactggacattaaataaataggtctcctcaatcataaggaaggattttaaaaggcacctttgagcacatgggataactgaaggagctataaattgtcattgtttccagaggtgtcatttgggatagtggcaacttggaaatagcactaaacatgataatgtaggttttgccaacacttgcccaactttcatgggctgctttacgtcaaggtaaccacaagttgtcaaattaactttccaacagagcatgttagggaagagtgattccttcttgcttgattttgttagaaatgtagagatatttggcagaacataatcacttcaatatgtaataggtgctaaaaattcctctaaagttcaaaaatgtaattttgtacaatacaatacccagatttcacaggtaggctacttctgcatggctctaaaacattcagagaaaaagttgaaagtgtatttaatatttgcatatttcaaaatgttcggtatcaaacatgttttctcagtacatgcctgttgaaaggtggacacatgggtgtatgttcaacaaaaagtagatagataatgccttaaacattggattgcatctctgttaggacagttctccacattagcactcaaagggtatcatagactatcatagatatatggttctttcatgatcattctcaaaagccccatttcaatctgaaattcagattggggatattttggcactgttaacagacagaactggaacaagacccaccacactctcctgactcttccttcaataacctttcaatatttctcactctttctttctttctttttttttccatttcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcata

SEQ ID NO: 3716 - DNA, 67676 bp, human
tcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaaggtgagtcccatctgaatgcacataatttaaatttgttgatttctatgttttttgaaatatgatgtgctttgaaatgagtaaaattaataatagcatgaaagtgataaattttgtttttttaacaaaaaaacagaatgtcaagatagaaggtcttaaagtcagaatgtcttaacgacaaaatgtcttaagtctttgtgtttgtagagctaagccaagtctaaagctcattccaccaaagaccacttaccacttatcaaaacagatatacttaaagaataaaaattgaagaatttttgtaggagtgagggattgtagccttgctatcgtttacttttttgtatatgatttagatgttacagtgatcataatccccatgtaacctagagaagcccttcactgaattatagcatattatccatagtaccaaaatgcacttaggagggacttgtcagctttcagaggataactaaagtcagactgagggagtataagggttccagaaggaaaattatggcattttgaagcgtctcaaagtatattttgaacctttaacttaaacgtattgctacaaaactaggttcacttaattttcctcctggacagatgattgaccaatttcagatttgtgagtatattttgtaaggaaagtcctattactaaggtcatcaagcctgagtattacatactagattataaacaaaatatgaggccagatgaggtattatataggacaggatgtatatgattgcagaaaaagaaaatgcactgattttcatgtgttattcatagttatccttaaattaaggataaaaagtataaattaaaacatagaagcaataaattataatggatttctggtttaattaagatttgctacaatgcatctgagacttttttcaaaatatgtcaaaatgaattaagcttaacaagaactttttcagtttcttgatattgttttaccttcatcatgaccaattttacctcattaacatttttatttatggctgcattggctaacagagatgtatcccttcgtgtgatggtttcctcaggaaacattttcttaagcgatatacaggttaagtatctcttatctgaaatgcttgagactgaaagtgttttcgattttttggattttagaatatttgcatatccataaagagatatcttggggatgggactccagtctaaccatgaaattcatttacattttatatacactttttacacatagcctgaaggtaatgttatacaatattttaaataattttgtgcatgaaacaaagttgtgtacattcagctatcagaaaacaaaagcgtcattatctcagccacccatgtgacatcatgttgacacttaaaaagttgaggcttttggagcattttatacttcaggtttttggattaaagatgcttaacctgtagtacttaaagggttacttttacttatttcgtgattactagttttttgttttttgtttttttttgcagaccattccattttaagaatagaaacttgttattgtaaagataaaggtaattcctaccattgaaaatctctgaattgcttttatttgtggtagacattatgactaaagaacttattttgttttcttcattttggtttcatttaagtttcatctacaattattttgtgtattatttaaatctgcagctacaggattgggcagtgccttgaagtggaaaagcatactgagttagttgggggaaaaatgaggtatctttcatctggtccatatagagggtcaggaactgcagtagaaactttgcattgttgtttcaggagatctggggtacagtcccagcctcactactgtatctgacctcgggcaacttaacctcacaatccttgagtaacttcatctgtaacagatagatagtatcttctgtacctaacttctgtgattattgtggagattgcagtaagctagtacaaatggaaaaccatatatcaatataaaagtgaattaaataaaaggttttcttcctatcaactaaatgtttgttgtaggcattctttaacaaagttctatttagttagggcttattatttaaaattacaaactcatgttccaaatgtacatgaccaaatctagttgctgtgtgttattagttgttcaagctaagtataactgtttttatggttactctgatatagagttccttgcaggctttgtaaattctatctttccaaacatcatagaatgtgaaaggagacatgtgatcttcctaatcattaataaactcaggtcagtaattccatttaaaggcaaaagagtgccataaactaaacattttgaagaaaagtactagggaaggtgactgtttacaaaatgcgtgctgcactacaactttagagcttggaaggtgtttaattcagagacaaaatagataatagccaatgaatattaataagccacttaattatttaaataagttgtctactcactgtatctagtgtttttaaagtaatgtttgcatcatgttaatatcctgatgaccagtcacacagggtaaagatgatttacataatccttacattctcatattttagtgaaaaccttaatatttcaaatatgtaaagccgttcaaacaattacttaatttgccatttagatagcacattaaacaaagttccatgtctgcacaagagctttgtagttcttatccatgacatgcatgaaggttaaattaagttgagggtaattgacctatgtgcattgtgctagtatcatatctataatatacaaataacatacctcagtggttactgcagcatttcctacttctcctgagtttttataattgaaacactgttgaacttcatctgtgtactatttcttctctcatgagtgattaaataactgaaacaatcatttgatgagttttgggctgctgcttttgtttttgttttgttttgttgttgttgtgtaagaattctattagtactagctactctaccagatgatggttattgccttaataacaggtacaacagatacaatgttctaactcacctcataatgagggaatgttatgaaaataagaagggcaaattggatggctgattgtgtattgtgctgaagtgctgtgcctatcaatccatgaatgttgagtgctcagtgatgaaggcagcaccatcttcaaatggaaatctagtgtagtccatggattaatttccagctacatagaatggtctcatatcatgttggtatgcagctgtttttgactctgttgccttgtggacttggcataatctgtctccaaagttttcttcaaagtatcgcttaatccattctatgccaatttcttgatattacagtttgccattgatctaggttggtatttttagtgaatgttccttggatttaacgaagggtcatcatttttaaaacgaaatcaatctttgtgattgttttcatagccaagttattctgcttcagcaatatcatgatgtcttgaacctttccctttatacttgaagcaatgtgttatcagtcactttttatccaggaaggatataaatgttgtcattatttcattatgacagatcaacacccatcacaactgtccacccctcttaccactttgggtagttttgtgccaagaatttcctggtaaaggccatagcagcagacatagttagaggatactcaagctaacctatatacattccttaaaaaatgggaactgggtaaggaatgcacataaaacagtcacatgccatgtcttcaaaatcacatatgatcacgagaaaaataatattttgacaagtgaaaccttgtcaaatattataagcatatcgatatgaatctatccttgtaggtcaaactggcccaagttaccagtatattctgcaatagcaacactagtcacagcagttttcattagtttaaaatttgactatttttgactgaatacttactcatccctatttgccaagggaaagtttaccagaaactagatgcctagcaacacaatcccaagggtcactggattatgcaagacttagcaccatttatcagctccatcagagaggtctgtctacactataaagacacataagcagcagctgtcatcttgagagtcaaggaaaataacattttatttaaggatctctattttctatgatgctaacctttaaagggaagtatctttgactggtaaaagtcaatgctattttggacatttcaaaaacctcttttgaaaggaaaatagaattacaattataggttggtgcggaagtaattgtgttttttgccatgaaagcaatggcaaaaactgcaattacttctgcaccgacctaatggtacccaaacaaatacatattgatagttcagcctcgccttttaaacattttattttgaaatattaataattttaggcttacagaaaagttacaaaagtgatacaggaaactcctgtatactttttatccagattcccctaatgtcaacaacttacatgccatgcattgcacagttatcaaaaccagggaattatcactggtacaagattcttaagtaaactcaagaccttatttgaatgtcaccaattttcttcctaatgttatttttctgttccaggatccaatctgggatcccacatggcatttattccttatatctccttagtctcctccaacctgtgacactttcccagtctttccttgtctttcatgaccatgacacttaggatgaatactggtcagttattctgtaaaatacatctcaccttgtgcttgttgaatgttttctcatgattagactgagatcatgtggttttgacaaataaaaaagaaacccacacgcagaaatgatgtgcatgacatctgagggtatgggatattgatatatcttattcattatgttaactttaattagctggttcaagtggcatctactggatttctccactgtaacatgaccagtttttcttttgtaaaaactgataactatgtcccccatttattcatcatcccctacaatatgccattgatcgtaatgggcatcccaatgtcctagatgttaaaaagtgaacaagtgttcatcttagaagtgattggtaatgtacttctataattatagtcaattaagaaagagagcaagggaaaatggaccaagagcatgacagagaaaatagcagcaacaagccactggaaagacagaacactggagagtgagcagtcctagaagtgatgtgatatgtgtgtgcctatcatatactactgcagagtgtgacagctgtccccttcttgttcatggccttgggacttagccgtgaaccagaaacagtccctgcctccatggtgcagacattctcattgggagttggaggaggagcaggtaaaaaataattaaatattcaggataacaatacattgtcaggtgtgaggaaagggtgcagagaatggcaggggctactgttttagatacagtggccaggaggcctccagtgaggtgacctttgaggagaggcatgcaggagatgaggggacagtgaagaggatttctaagaacattccaggcaaagagaatggcgacagctaaggccctgaagctggcggcagcctggtgtgtgtgaggaaactcaagatccccagcgtggctggagcagagccatgaagggggagggcagtgggagatgagggcagggaggtcccgggggtggggagatcaggtggggctctgtgtatcatgctgaggactttggatcctgttccaggagctggaaaggttgacataatcgggggaaagcaagcccacacaaagcagaggtgtctagtctttatattttttaagtggaaaagagaataatttccacgaagacaaataactcctgtttataggtgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagacattccatacatgcctctgtagtttgctgctagagagagagagtccttgtgcatgtggcttcgaactaggaagaacattggaagcttgtgctgggcttctcttgattctactgatacgtatatttttcctgttacttttcctctgtattccaagctgtaataaattttagttgcgagtgtaagttgctattgagtctgtgagtcctggcaaatgtcaaagaagcttttctgtatgttgttatttttcatacattatttgcttgattttttttttttacatttttctgttttttatgagaagggctttttcattttgtttctattttttaaagtttaatttttgaatggatattttcataattcaaaaatttagaaaaacagtcaactaatgagtacatcaacaaaatatggtatatacatacaatgtaatattactcagctacaaaaaggaacaaagtactgatccatgctacaacatggatgaaccttaaaaacatgatgttaagtgaaagaagccagacataaaaggtcacatattgtgtgattccatttatatgaaacatcaagagttggcaaatccatagagacagaaagcagattagtggttgccagggtcttgtgaagggcagtagatgggtgagtgaggggtgaggggtatgggaattaactactaatgggtacatggctttttttttaagggtgatgaaaatgtcctggaattagtgatgatagttacacaactttgtatataaatgtgttaaaaactactgatgtgtagactttaaaagggtgagttttatgatttgtgaattatactcaatgaaaaagtttaagaaatttcaacgatagtagagtatgcagcgaagttttcccctcatctcttttccccagttaatcagttgacctccaaactgatattttggttttccctctcccatagatattatatatatacatatgagcaaatatatccatacttattttccattttcacacagatagtagcatactgttttcctccttgctttttttgagtttaaaatattaacagtaaaaagatgggaaaagctatgtcatgctgacactaataaaaagaagcctggaggtgctatatttataataaagataaaaagaattgcacacaaatacaggattctagttagtaaatctgttcctcacaggcatatgtaagtatgtagatactgaggttgaacaaataaatgtatatagagtagataatgagagcctattttctcactatcagaggaaaaaagttaaaaataaaaagggaaggttaggatgaataccgtggtgtggattagaaaggacacatgagtatgtatacagatagatacaggaatagatattgatctgtgtgtatgcatgggttattatgtatgctttcatttcctagctctgtcttgggaagccctagaagcaattaacaccccaacagcaacgagtatacttagtacccacatctttgtgtctaatatcattctccaataaaggaactcgggatctttggaataatggctaattctggacagaagcagggaaaatacaagatgaggctgtaatgtcttttggtgtaagaatgtaagaaagtgctagagaaagggtgggggcatgacaagacagcatagtagccagtctgaaggagctcccaatggctgaagttagaataacttgagcaagaaactaaatgatgacagtattgaattatagctcatagaataaaatagatgcccatgagtccatagtttacaaaaaaaattgaataaatggataagttggggagaagggacaactcctccttacagaagaattccaattaataaatggagaacaaatgaaggaaacacaaaatcactagtaggcaaatgccatggtaataatggttgcaggcaagatccactgatatatgctgaaatcagtgggtaaaagttggaggagaaacaggatatttgcattgtcccaaagtatttctcccaggatatttatcaattaaaaatagaacaggcatggtctatttcatttatcaataaaaaatagaccaggcatggtggctggctcatgcctttaatcccagcactttgggaggccgaggtgggaggatcttttgaggccaggagtttgagaccagcctgggcaatatagcgagaccctgtctatacaaaacatttttaaaaaaattaactgggcataatggtgcatgcctgtagtcccagctactcaggaggcagaggatcgcttgagcctgggagattgaggctgcagtgagcagtgattgtgccactgcactccagcctgggcaacacagcaagaccctgtttctaaaataaataaataaagggaaaatagtcactttacagtggagaaacccagcagatgccactttaaccaggtgtttaaggttaacataatgagtgataagatatatcaatatcacataccctcagataggatacacaccatttctgtgatgttcctgccaaaaagacatggtctcggtctaatcatgagaaaacattcaacaaacacaaagtgagaggcattttacagaataaatgaccagtactcatccaaagtgtcatggtcatgaaagacaaggaaagacttagaaagtgtcacagattggaggagactaaggagaagtgaggaataaatgccatgtgggaacctggattggatcctagaacagaagaacattaggaagaaaattggtgacattcaaataagatctcttgttaagagtctcgtaccagtgttaatttcctggttttggtaattgtgttatggttatgtaagtatttaacagtaggggaatctgggtgaagggtatacagggactccaggtattatttttgcgatttttttgtaagttcaaaattatttcaaaatgaagtattttaaaagttagcttttttagtctgtcctttgaggctcagaaatattgtggggtattgtttcttttcatttttattcttaaaaaaaaaactttgagtatggggatgagaaaactctaaaatctagtcatgactgatcatgagattgcccccaccaaaagttcgatgactcagatatcttcatagttaagaaagcgctcatacatataaaagcacttcacaaacctagcaaacgaagaattttggctgtagaaggaagaacgttcagttcaaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatcagattttttcgaaatgtggatacaaggtacttctgtgcatccggaaatagcaattagttcttctaggaacatgacattattcatagaacattgtttacttactgttctgtttgcccttgcagatgacctttctgcatgtaccatccttgaggtgacccttgttttcctctcagtgtgtcacttggtccctgacttatggggttatatattccagaggaatcttagctgtctgctattttctgtaaatactcttttttttcttcagtgtttattctgctacataatcggtcttcagtttcttaaatttatggttttttttttttaatttttgatgtctaatccagatttgcagtcctgcttgggttttcaatgtttttgtttctgtgccttcaattctcaccccagggtcaagttttattgctagatgtcattacaagtttatctcacattttttgccatctttcttgatattgttttctttaaagtcagtaaacaattccatttgtttttcatccttttattttctaaatgatctccagtatttggattgaaccatgttgtatctagagatagagtaaatcatttttcggtatcttgtttatgatgagattatgtaaaattgcttaatgtcatgtctaatatgttatttagttaagtagatatggctatagaatctatctgttagaaacagttttgcagctataactcggtcataggcatttaaatgtatgccttaaattggatttttgtatatcataaataagctttttttctgttgaagctcaaattttttttaacccactggaaattggtagaaaataaattaggctttgcttctacctatattcttatgagtagatagtggacaatgaaggcagtttccacgttgaaaactgtacaaaaatttgaaaatgtaaagtccacagtaatataaatgtattacatatgacaaattccctttaattccattaaatatgacaaaaaacaagacatgtcctatgtatcagccatgatttgttagctaacggaacggtagtaatgttctaatttctgtcttagcgtgcaaaaatgcaaacagaaaacctttttctgtgactttaaactctttaaccatcttttatatgcatctaaatacagtgagtagattacattgtagtatcaataatctcttagctccaaatactttttagagatctcatttttaaaaaccacattgttttaagaccacattgtcacattgtcttaatatctttgttcatcttcccatttgtgaaagatagtaaaaccgaagtaacaatttgaggatttttaatagcttcatgtactctgtgttcttgttttaaatatttcacaaatacctatcctaggagttgttccacttaacaaacttaattttttccagcttttataaaaatgtaatctctagtgtttctgcaatttcctggttattttactttttttactaaccaaaaaaagtgttctatatagaaccaaattcagtcttaacttcagtattactaacaaattttaaaaccatagccatctttaatctcccagtaccccactgtaggaagaatttgactttggaatattgtctcatttttcaaaggagcctgagaagtagttttggaaaatacctttttcttgggtgaactctagatgtaaccactgaaaatatctgaaatgaaacattctatcagcaagtggcataaacatcgaaaatgctgccttgtcacacataacagttctaacaagggctccttatgtcatgggaatcctactacctctgtttctcttcatatgagagcaagcagcagcactgaatttgtaagactatttggttgtggtttcctagaaggatttgtataaatgtcaggggttatttaatgctgaaagtcctgttaaatccattaagaattgtatgtacattcaattccccaaagaaatgattcattcaacaaacatttattgcaacctcttacttgttaggcactgggctcagtaatgtggagaatacaaagttaggaaagatgtggttcttgcctgaccttttagtaagaggttacttgtgttatatgccataagccagatacaaactaacagctacaacagtccaagggcacaggtagggactgggattatattcagcagtggtggttgaagatggagtcatggcagagacactgtttgaggtgttctttgaagaaggaataggaaggtattccaggcagaggggataacctgagcaaagatagagggggaaaactgtgatatgtttggggagttgaatgttaagtcagaatggctgaagcatgagaaatgacaccatcagcttgtgcaaaaaaaatgacagaaaaaaagagactggcaagaggaagtacctcttagaaagttgttgaagtattgaaggtatgaaatattaaggttttgatttagatggtggtggtgggaagggaaaactagcgatggaattgagatgcagatgaagccaacatggttaagtagaaagcagtggatatttccctccagcctactgaccttgtgctcatcttaacatcagatttctttgaagttgcagtgaaagtctgccatactttttgttttgttttgcattagatgctatcttgtccaccaacatatcttttgtgcctagtacacgttagggcttggaaaaatatttgttgaatgaaacatgagattgttgaaacactttgaaagagggagaataaatatgggctcaactgagaggtacacagagatctcttcatctgcagctgtactttcactcccagttcagtttttactcaaatatagatgaaaattgtatacacccatgtgccaactttcctcactcaaccacattttaacctagatttgatggcctgcaaattgctgatatttgcaaatttaattccatcccttagcattatagaaatgatatttggctaaatgctgttggatattctccaactgttacattttcagtgcttttacgttatatacggatttttttaaaaaattacttagtggccattgttaagtgttatttttaagataattagtgtgattatgtagtaatggtctagcattttttgtcttaaaatgtttgaagttgaattttacagcagatgggtagcttgcaaatcaaggtattcttggaagcataatgagtgctaataaggtgattctaatcaagtacaagctcataatcttcaaaaagggattttgtggaaaaaggtgactgcctagttcaaaaatatatatatttaaagtttaataaagaactcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaattatggcccagagaagtctcattctccccatggaacttgctcttcctcattttcaacagcaccactaaacatgcaccactagttacctttgatctccccactgttcacaacctccaagcaggcgtcaagtcctaggtcccccaccagcacaactactcatgcctctagttatgggagagagaagatttgtaaactccttgtgggcagtttccatggcataatcttcatttcttccatagtatctagcacagtttttacttttatgcaggagaggtattaaacagtatgccttcttttatcaggctacaggagcaaatgcaattcagtacattttcctatttagtgttgccagaaaactcacagctaccttttgggcccagctgcagcaattaaccttagtctagaattttgaagtttttgatacaattatctccattgttccacctttcccattatatcagtctttacagttactgtaataatcttacttcaaaaatatctttcttgaaggtcattttgaagccttttgggaagaatgtaattgtctaagtagtaagagagcaagtcaacaagagaaggggctaattccatttctgcatttattatttgcagcttataaggctatctgagtgattttcatttggacatgttaatgtattccaggcattccagtatggttaactgggggcctcagtttaaaatgggcttccagtgatactcagaagtaaaccagatgcagctggggctactcgtaaaacagaaaggaataaataacaaatacttgaaactccttagacgtttactttttttcattaggaaaaaaggagaaagggttgtatgagatgtgttttttccttacttcctcgctgcagggtgcaactgatgaacttgtattcagtgcttattttgaggtttagtaatctattgatacttcggcttttgatcatctgtgctgaaatgctgtggtcagcattaaattgtttgcctaatcgatctggaaagtattttcctccttttagcttgtctttttctaggtatgttttttttaggggtgaggagaaggggtaatgttctcaaatgattgggatttctgtagtgagtaaaggtgtgagtttattggagagctgaggggcagtttttaaagaatcctttattcgttcaaatttgggtacacagaaaacatttagaaaacactctggaaatgtttatacagcaaatgtaagcaacatacaatacagagctctcatatacatacttaccatcataactaatagccctactttgtaaacagaaaatgaatgtgtttcctaggagtagtagaatagattttgagaaggccaatccttcttcatgacctagaccggccttcttttacgtggctgctaacatcattactgatgtcagagatgtagaattaaggtgtccaaatttctttagtatgaccttttggaaactgaattatcagtaccataataaaatgcatagcaaataactaaatccattgtcggataggacaatattcccttagagcaggggttctcaaaaatgtggcagactagcaacatcaacttcacctggacacatttagaaatgtaaattatcacctcacccacacctactgaatcagaaactctgtggggaggcctggcactttgtgtttcaagaaactctcccggtaattctggcaaacactgaagtttgggaaccattagtttagagaaaaccataattggtttagcagggtgtcaattaaggatgatgtttcaaagcttcataattctcaggattctgtgttgttcctctaatgcctcctccttcctcaccacttgttcaaacggccctttcttgatatatattcagatctgttggaagggaaatgatgtctattctggaagacttaatgtttctttgggagacctattatattttccctccaaggagcatcacaatgctttttagctgagaaaaggctctgagaggtattgcatgaaagacagtttagttctgttaactgcgtgttagtgtagtttagttctgttgaacccaagaatttctgtaaatcctttgatcacagaaccctatctttgtggagcatagagaaacttatggaatgctacataacaggtgactgggcaagaatcatgctggtgtctaaatgtgtggaacccaaaagaaatgaagttattttaattatttgactattataaccctttgaaaggattagtgacttttttgtaccctgaaaggcgtattgtaggtgttgctagctgccacacatggaccttcaaattttcatatgtagcaactgtgagaacaaaagggtgtgtatatgtacacacacacacacacacacacacacacatagtatattcagacatttcacatttatatgagtcaatcttcacttccataaggttagcctattaaaatgaaaaataagaaaaatgaaaaattagctcaaacatttataaacagttttctaatgagattcaattttattattttaccaatttatttaaatgatatttaaaatcacttcgctacaatttttttttaatattttaagcaccattaacatcttttatagtctcttatttggctttgtctttctaacttaccaggaaaaaatgacttgcctgctttcttgttatcattttaatatatgttataagtaaaatataacagtacccatggcaaaattagaataaaaatagtaccaactagagtgtgatgctccatgcttttttatataatacaaatgactttgaatgtttcattcattatgattttaaagtggatgttcgttatgctaaatcttaaagaagcttgtgatggtaaaagagtgtctcttgactaggtaaactagtctcctaagtgggcactggcttattaccacttgaaaagaagcaataattattttctccttttagttatttacgaggatgagattaaagcttggatatgcttcctttatcctctgccttttcgcctagaatactactaagttgtgggaacagcgactgtttgacaataatatccagttctaataagagaagtgtcctcagtttcctaacattatacgtatataaattctctccctaggcacatagtaatttatattactcatataattggtaattactctatgataatatattacctcttttagggaagtagaatgatttaaagtagttataatctgtcaaagttattatacttaattctcgggaaatattttagttctgttgtaaagaactaataaagaaaaatatattttttacattttgtactgattttacttgcaaaacagactaaattttactttgttccttttttctttcaaagcacctagaaagtatgtaggggcaggaattatttctagagaagttaacacgattggagaataatttaccgatgatctaaaactaaatagaattaagggcacttgaatctcagcttagcactctttctaataaaatactgtgttcctattgaaacttaaattcatttcttcttgggaacaaatacattagaggacagagtatgaacagcctgtgacctgcttccgaaacagttgattcatataacagtgttgttgttattattttccctattatattgtctttagaactattagtatacttttggattctgcatcttcagttgtctagtcactttttattttttctgagacagggtctcactctgttgtccaggctggagtgcactggcaagatcatggtgagagacaggactagctggatttcctaggccgacgagtaatccctaagcctagctgggaaagtgaccgcatccacctttaaacacggggcttgcaacttagctcacacccgatcaatcaggtagtaaagagagctcactaaaatgctaattaggcaaaaacaggaggttaaaaaaaatagccaatcatctatcgcctgagagcacagagggagggacaatgatggggatataaacccaggcattccagctggcaatggcaaccccctttgggtcccctcccattttatgggagctctgttttcactctattaaatcttgctactgcacactcttctggtccatgtttgttacggcctgagctgagctttcactcgccatccaccactgctgtttgccgccgtcgcagacccgccgctgacttccacccctccagatccggcagggtgtctgctgcgctcctgatccagcgaggcacccattgccgctcccgatcgggctaaaggcttgccattgttcctgcatggctagtgcccggattcgtcctaatcgagctgaacactagttgctgggttccacggttctcttctgtgacccatggcttctgttagaactgtaagactcactgcatggcccaagattccattccttggaatccatgaggccaagaaccccaggtcagagaacaagaggcttgccaccatcttggaagtggccggccaccatcttaggagctctaagaacaaggacccccagtaacaatggctcactgcagcctcagcctcccgggctcaggtgatcttctcattttaaaaagctggggagaaacctaatgataaatcacagaatagaattgttgtgtttattttattggcatgtttacatgatgcagccacatattaatttgtatttgaaaccctttagttttattttgtgaataatgtttgcttaaccaaaaataaattgccaataaagaaaagaaaagaaagaaacatgacttgtacatttgaagcactgaaaaagtcaaaccctagtgcctagggccgcagatcttcacctccactttgcagtatctcaaaatatatctactttacggtcatttaactaaaacctcctctgaaactgagctttcggtggggtagtcttttgtgaaatggtgtgtgcagttcatgtgcgttctcatttgcctttgtccttaggggaatgaaatgcttcagaagaacactttgtaccattttgtgttaaggttgatcttttctcatcatttggagactttctctgctttgtgatagtgtcgaacctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaatacaaaaattagctgggcatggtggtgtgcacctgtagtcccagctactcgggacgctgaggtgggaggattacctcagcctggggaagttgaggttacaatgagctgtgatggtgccactgcactccagcctgggcaacagagtgagactctatcttaaaaaacaaaacaaaaccaaacaaacaaacaaaaacaaacacattcaattgccttgacacattcaattgccttgtcttattcattctcaagccatccaaaatccctgggttttgaacaaaataaatttgccataaaattgtgctagtaactagtgtctggacatacctaacagccagttgatatgcagtctttgttataatcttagagggaaagtgtggcccagacagtataaatatttgaaccagctcattcctctatttagaactatcacagtattatgaagcacagtatcttgattgagtatgagctctggacacagagcacgtaggttcaaatcccagctctgctacttattagttatgtcagcttgggcatgcgtcttcacttctcagtgcccccgtttcctcaattgtgaagattaaatgagttaatgcatataaagcactttgaacaatgcctggcacgtggtaaatccacaacaaagttagccattaatattaaggtggacatggtgtgaaaaaatggaaaccagtttacagtattctaaaaaatctctcaaattagttttgtttctatgactagttttgtttttaaaattagtttatgttttatgactactttcatgatattaatagaaaatataattttacaggggcctcaacctggtgtctaaatgtgtatcaacaattgtctcatgccaagtaacatgagctaaagctgtatatacaatatctgcagcttattcataagtgatctgaattagttaacatgaaaaggatcatttgaccttatatgcaagagtctagtataccaagtcaatgcaatacatgaaacaatgtaaaaccaaattaatagtctagttatctttagtagaaaaatgagtgtaaaagattagcacactgatgttttacactacctagtttctttcgctctatccactttgtcaaaatctttgagaatggaatttgatttaccttatataacagacataaactgacttatttttttttcagaaagatgttttctgaagttttctaattttatcttgattttgagggaaagcacaatggagctagagtagatttattttatttatttttcttcaccaaaataaggattccgctaattaaaaggcactgactagaatatcaccatggcctgaatgaccccagaaatcttttcgtgcttaatagaaaggatgcacatttttaatgaacactacatccttagacatgtactgctcttctaataagtcttgttccagctgtttaaattgactaagggagtacagttcatagattttgaagctaactaattaactctctgttctttgctttatttttttcttgttttgggtgtggagatatgcatcctttggcagtggtcatatttcaacttcttctctgtaaggccatgagacatttatggttgaggcattgatttattttaaagcaaaaagcctccctttatcactattttctttaaccccatttctagttacattgtttgtggagggccttgtttagttctttaaatattgggaacagtttcatcatcattaaatattaactgctcactggaagcagaagctgagcttaattaaggttgcagtatttactaaattagactgggagaggaacattttaagacacacacatatatgaaagagagagagagagaaagaaaaataaatattttacagtaatctcagcagtttcattagagctttgtcaattgtgttcgcatatctgaaacatttcatcccaaaatgaaagttacattttggatgaaacttaacatacttggtagatattcaggccaggcagaatagatctttatttttagaagagaaagcatttgtatcaataccttgttttcatgtctgtagaacaaaaacaaacagtaagttggcctaattttcagatgctttttaaaagaatcacttggctaaaaatgccacttaaatacacgatacatttagagtttggaattttccctgggcatatgcctgatactctaaattacatacaattatattttatttgtaattgataattattatgggaacataacagttgtgcatatttgtgggatacatgtgatattttgatacaggcatacaatgtgtaatgatcaaatcagggtaattgggatatctatcacctcaaacctttatcatttcttcgtgttaggaacattccaatcctactcttttagttattttaaaatatacaataaattgttattaactatagtcaccctattgtgctactgaatactagaccttattccttctacgtaattgtattttgtacccattaaccatcccctctttataaaccccttctcactaccctttctagcctctggcaatgatcattccactctctatctccatgagttgagtgggttttttgttttgttttgttttgttttgttttgttttagctctcgcatattagtgagaaacgtgcagtattgatctttctgtgcctggcgtatttcacttaacataatgttctccacttccaatcatgctgttgcaaatgacagaattttgttcttctttatggttgaataatattcaattgtgtatatgtaccacatgttctttatccattcttccattgatggaaacttaaattgattccatatctcggccattgtgaataatgctgtaataaacacaggggtgcatctctttgaaatactgttttcctttaggatagatacccagcagtgggattgctggatcatatcatagttctatttttagttttttggagaacctccatactgttttttttttatatatatagtggctgtgctaatttacattcttaccaacagttgcctactttcctacaattttaataacaagttagcacaaaggtttcaatagaacttttggtgatgaaatgtatattttccctaacaaaatataaacttagtccatgcctcaaaagtattttaatggcagtccatgtcaccaagtaaaaactttctgcatggaaattccatttttggtgttaggttggtagtagggtaggagtgtgaggaaaatgcttattctgaagtggagacatttgacctcattgggggattgaaacataatttcacactgattaattcaccctgtaaacaatcattttggtacaatgttttacatttctttatctgaaagaagattcatgtttaacaaaagaggaactgattttcatctttgtaccgctaatttcaaaatgcagaggtaaatcaatagccatatctaccctttatataaagtttgagtggagagatatgtggctggttataaagacataattatttaatttattctgagcagcacactgagccctgcaaagataaattgtttaaatctgaacaataatcagtgcctttctcaccttatactcttcatatacatttgtaagatatttttgcaaattaaattcttctttgaaacttttcattttacttagagacaggaaatttaattttaccaagtggaaaccccaaggtttaaggttagtgcaaaactaaaaccatttggaattgaggagattgcccaataccttctgacttcccaggtttcagtacagcgaaaactcacttgagacccttaagtcatggaaagcctaaaataattagcatggtttcaaggggcagaagtcacaatgtaggaaagccagttaggcagagaaggcttgacgttcttatttcagaagttccttgactaaagccttcaaatgaaagaagaaagccacggcaaccatttggaaagatctgacgaaacttacagctttgaaaaggggtgttgggaaggtgattgtgggatgttactttgcaatcataggaaaatatccatcttgttagcttttgggagatcagggatgggcaaaaatggcatttcaacagaagagccatttttggggagttcactctatttttctatttaagagaaatcaaaatgaaaatactaaggaaaacttgacctgtaaaacaccatacaacttggttgaagctttagtttctttacctatagaatgaggaagttggattagatcagtattttcctaagggtgtactaaagagagatgttaacgggaatatgatgaaaaaaggggggatggtttgtgagttaaacaatgttgggaaatgctgggttaacaaaggtaaccaggtttctttactttaggacatgtgagagcctttatcatactcttgtgtattgtcagcctacaagagaggaatataaagtgacatttcttatacccgattgaccagtgaacccagcttttgaggttcctctcttgggattagttgtctgtggtacacactctggcaaatgctggactaaatgatctctaagagcctttccagctttactatttgatctttctatgatatgcccataaacatataaacttccccagagcagtacaattttactatttctgaccttactaattcttaatctttgatcattccaatgaaagagtctgcattcttaatgaaaaaataaatttaggactgtgtctagcaattgcttaaatgttcacaattgtaatgtgaggctattgtggattgccatttttctcgaatatattatttggttcattagaattagccatacctctctactttgtgctctcttttaatgtgagtaatcagggattgactgaaaaagatatctatgcaaataatggctattcatctgcatgctgtgaatctgtacctttatagcgcttatgtgtgcatatagaaacatgtgctaagtagttatttccctgcactttaatgattgacttttactcgaatttgagtattccaaagacagggctgaaggaaaaaaagaaaagattaaccacccctcacctctgcacacataaataaaaaccttaaaaaacttaaaagcctcatctttatgtaacacctcatatactcaaaaatctgttctgtaaattcggagttacgggtttaggcaggtattggtcacacaccatccccctcttcatcctagcctaaagggggagctccagcagacatcgagggtatttaaatatactgttgcgccaccggtgggtgggaaggtggagtggctgccagggtagcgagccgtgtgaagcttttggtgggaggagctatggatcaaaaattgctgtctccaacagtcaacttccttaaatttccttgcagctgatcaggtaagctggggctgagagtgtcttctactttactctgggcaaatgaaggcctgggagagcctgggctgattccatggagagggcttctaagaatcttaaggtaaagaggtaaaatgggttttcaaggatttgcctttattgagctcaacttatcaaggcagaagaacagagcgggagagggctgccagataacatattgtatggggcatacttatactaaaaaattttttttcactgtttatctgaaattcaaatttacctgggagtcctgcatatttatttgataaacctggcatctctagagaggatcctaagcagaagccctagctggggaataaagggggcaagcagctggtaccctctttgtcctggcttctaaatcgttgtggcaagtgagtggatggggtgtccagaaaaaggaggtaaagaagcctaggagcaggagatttgactaatgggtcagagagaaacacctccttatgttctttcttaatgaagtccatgtagaaggagctttttgaagttatatgattttctgtgtgttttatttcttagagtaacaaattcagtaccattactttttctctccctttttttccattcttgatgacattttatgttggcagctatcagctgctctaaagacagcgtctagtaatactttgcatgaggaatgccttctgacttttgataacttggtaccaatgtgcttcgttgtgtttgggttttaattttattctggttggctggtttgtaaatagatgatgcatttttgaagagcttataattgaccagtcattcagttaatatttttctacagtgatgtacggtattcgatgagaaccgaggtaaaaagtgtgtaagtggggtggaatagggcaggaagtagatttgggttattagtgaggcaggcttgctttcactgtgaacaacttctgggatttttagtgttatttgctgttcaaaaaatttctaagaaaaagatcaagctcatgatcatttgaaaataaatgtttaacgtaaacaaagctaagcgtgggtcatgaaggaaagccgcaaacatttttcttgtaagaaggcatatgcattagagagccacaagaaggccccacctgctgtgattttcctaaagccacctttgtcttagtagcttcagggaatttgacttgcggcttgttcagagaaattcaggatggggggtggggcagttggagaacgcagtttttttctaaactgaccctggaaatgcagggccctcctgggcaggcccaggtgctgattagatatggatctgctgctggctcctttattcgtccggtggggccctatatcctgagggcctttgtggccagagaccccttggaatcagaccagagtttctgtctctgggtctcatggattcatgtcacttctggttaagttatactaaattaccaggatgtttcagccgtaatggtcacatattcctcagggtctatattcataggaaaaaaaaaagttaggaactagctattttctggacctgaatagaataacggttcatttggaacagacaaccaggggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattctaagaggaagaaagtgggaaatttgccagtagaatgccgatatctggctaataactcgttgtatgttgatcttgactcaggtttttcctagctttaataaatctgtgatgcttgcaggaactagccaaactggtacatatgatttgtaattctgaaatcactgttacttcctctgagaagccatgtctgtgcatgtaagtatgttacagtggggcactatcatcagaattatttcatttaatccattatgattaaaatggaataacaacatttttcttcatagaacaaatcatctcttgggtgccttgatttaacatttaacttttaactgttggcagtctagcagatcagtgagattatgtatttgaaaagtaatccagttataattgtatttgagagaacatatttaggattttttttttctctctaactctgtatgtatttgaagaagcaagtcattctgcaaacagctgtttctcttaagatactgtggctgacaaagggtaatttgcagcctcccaggttccttttcttattctgatgtatggtagggctttttctcatgaacatgaagtacatttcacagggtttttctaccacccagtgcatgggaagtcttgtgacagactctgactctcataactctctagacataggtgggatttgaatctctacaatgagacttttctctcttagttaaaggctttgtattcatttgggagaagcctgaaggtaggaagaaggcaatagattgaatttgggaggctttataaatgttctgcaatgtatccctttgtctgtcatcaacttcttgatgcagatgtacttcagaaatgtcatcggctattttctccccctgcttgctgctttttgagtgcatttttcaaagacagtcgatgggaaaggggagctggaagattcatatgattcataggtgtagtagcacttatttcagcagagaatcgctttcctattgaatcactttgctattttcttaactcagtaacacagtgaaagaccagatgagaatgacatgttttttaagtccaaaaggaaatggaaaaggagggaaattgaggcaagcataaatgagcttgcactctaatcgcttcaacgtttctttaattttgagtgtatatgggagggggagagagagagagttgattttcatgtcttgactccccttagctgctgattttagtacgtagcctgctctgccagaggatggcgactgttgtaggtacgtttacagagtcgtttaaggcatgctctgatactttgcactagtgtgagccaactctgaacctgtgggtctagattggaagaaggagggcttgggacaccattgacttggctagggaaacatgaagggtgatttttcagagccaagatggctgctgggctatcacaccaaactgttatagacccaatgtgatagggtaccttgtggcccactcagagtgcttaggtggcctacagaaatcattggaaccttcctagtacagagtcattgattttccaaaggacaaaaacaatagatgattacctactccactgggacagtccctccctaatccccactctatcccaaccttacatgctttaccaaagccttaattctatacaaggattaaaaaacaagtgttaacagatgtaaaaaaaacaagtttgttctctcccaaacaccaattaaagtattttggcctataattacgtttgggcctcttgaagaatgaacgctatgtagaggagatttattatcaccaagtgttgtgtgtacaaatatattatcctgagttctaaagtcgttttgaaaaaacaggggcatagttttcttttgaaatgttgtattgcacggataatatagatgttaaattacttggtctcctcatctattgtttggatagagaatacagatttttattttattttataagctttctggaacataagcagcagtctctggtaagatggtgttgctatgcatttgcattgttatagaattaaattatggattcggtcattcaaaatagaagctttataaatcaagtaaaatctcataactaagatgaataagtttctttaagtctcatgctgcctcatattccatactttagttttatagcccaacttgatataattttttaaagtgtaattctctttttttctatttctgtgtactgtttttgctctgctaaactgtcattatttcccaagaaaaagcttaagataagttactttatgtaaaggatagtgatataaaagcacaaaggcatgttcacttctttatctgtatattggcaggaaatgtgccaaatacagtgtgttctctccctccctttcttcttctctctctgattacattcaatgtagatgatattaaaactcaattgtaacaaatggtgaaattccaattattcttttttctttttttaacttatctaatgtctggaattcctgaatatgaaagacagtcttcattatatagttgttttggagttaaaaattgtgttccacgcttgtgtatgctaattgtctaaacaagctatctaggtggctctgcaatccttaagcaatgctgctgagctgcataatttattttccccactactgctgtctaactaccccaaagcataggaattagagtggtggccctaactgggagtatgcagtaagatgaaaaatagtcaaatgagaaggaaggtcagtaataagttatttagacctggttaggcagcagggtctccaaatgcagctgcaattggtaaaaaaaaaaaaaaaaaaaaaaaaaaaaaaaaaaaaaaaaaaaaaaaaaaaaagactgaaattcagaagagaggtcaggggtagagatagagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgcttcacattggtgggtgtaaaaagaagcttatggtctctcttaggggtacatttatggggaaaagaccccaattattgtgatttagcacacacaggggtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtctccggaacctaaagaacaaaatggctgccgggcatagggatttattatttcattaacagactgtcagtgaatttcagggtgtttctcgccttatatggattcaagatgaagagttttggagcttagattgtccccagataatggagtccaaaatttatctatttgtgtatagttttaatttaatattttccctattcttcattgtcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttgtaagtcgcagctatattttgaaaattgccgataaagatcaacagtggaataacctggcagggacttggggaaattagttgcaacaggatttaggacacaaactaatatgttcattgacactacagagctgtgcacttgaagagagcagtcaggtgtgttgcactgaaaacctggctgcatgagttcactttataaaagaatatggataaaggagcaggggcattttaagataaggagagttgattattattacatggaaacctttgaattctaggacattaattcaaacaaattttcttgttctttgatgggggttttgttgctttttttttttttttttttttttggtgagacagagtttcactcttgttgcccaggctggagtgcaatggtgcgatctaggctcattgcaacttctgcctcccgagttcaagcaattctcctgcctcagcctcccaagtagctggtattacaggtgcccgccatcacgcccagctaatttttttgtgtatttttagtagacatggagtttcaccatgtccaggctggtctcaaacgcctgacttcaggtgatccacctgtctcggcctcccaaagtgctggaattacaggcgtgagcccggcctgttgttgcttttaaataaacgttttattttgaaataattttagatttacagaaaagttacaaaggtattaatagtacaaagagttcctgtattacctttcacccagttctccccactgttaacatcttatattaccctggtagatttgtcaaaagcaagaaactggaatcacacatcattattattaactaaactccagactttattcagatttccccaggttttctattaatgtaatctttctattccagtgtctgattcagggtaccacagtgcattcatttgaattttgcctcccctctcttctctgctctgtgaccatttctcagtttttcccaatttcccatgatcttgatagtggctttcccttaacttagctacagggtttccctatgcagaaattagtaagattatgtcattctagactaatatctactattttctggacttgcaagtttaaatggatcctttataaagtaattaagctatatctgttcatattgttctattgaaaattcatcttgccctatgccttaaaatataaactttcattttgcttttacacctcttagggagaattgaaaactgtcccttttctgctgtagttcttcaggcctcacatttagctcagtggtgcctcattctaattccagctggcctacttcctttaaactattaacaggataaatttgaaaatcctgttttacctttatttgttacccatttaatcagtgatacaatgaacatattgaaagttgaaatatgtatatagtatttagatgcaatgaaaatgggggaggacaatcagctgtcagtaaagcctatctcattataaagttaattctcagaattcaaggatatctgtgttgatatggaaccctttaatgagtacatctttatggataaatgcaaaaacagatgggagaggcaatgatgaatcactaaaggtttgcaccatactctttttccagaatgtctagacagatttaagtaaaataaatagatgtcatgttctgtactattagtttaccaaaaagttttgccttggaactcagattaattatgttggtaaattagttcctagaaggtgaactcctcaaagctcctctttgaccctcagtaattctttacatcgttgaactccttgcgcaaacgctttttctgggctttcacatactgacgtatctcagtccctccctacttctaagggcagagggaagataaagtcttttggatactgaaaattgttatgaacaaaaccacagagaagtgatcgtgcttggtaagtccagaaaatgtgagtgggtggggaataaagcaaggcagcttctattttttcccccagctttattgaggtataattaataaataaaattgtgtatattttaaagtgtacagcgtgtgatgatttgttagacgtatacattgtgaaatgagatgacatggatgaacctggcaggcattatgtcaagtgaaataagccagacagagaaaaaacaaatactatatgatctcactcatatgtggaaccttgaaaaaactgaatgcatagaaacagagagtagaagggtagttgccaggggatgtgggtgggaggggatgggggaagatgttggtcaaaggtatagcaagggagattttaactcacaattattactctcagcttctcatgggatgtctcaatttcaaactgagcaaagaataggaagcagatttcattatcagacacctgagcccagtggttcctacagagctggagcatttatcttttcaaaggtcgagggatagcttcagggtactagtgaaatgccttgtttcagggaatcagagagcaagaagtggggtaaagtaggggtacagagggaagccgttctattcagcctctgctagagtctctccattccaagtctcaacccttcaagtgttattgatcgtgctggctcacactggagaatagggagtagcttttttgagaatccagtaagaaatccattgtgctttccagcctcttcacttgtgctttctaatttgattctctatgctttctatgttagaatatgtttccctatcttttcttcaatgagggtaatttcagatttcagatgacggaagatgactgctatgattcacaggagtacaatttattttatagaatgttacaagatacaaggcattacttagaagacccaagggaacaattggaaattgcttctctaccttgtagattatttaatgatagctgttatgatgcgatgagccgataaatgattaattcctgcagttattatgtgtacaaaaatctaactccgagatggttgatatgttcctcttctatggtctaaggaagccactttgtagacatggtgtaattgagctagtgtgagcaattttaagtaacatttaccagtctgatttggaaaaaaaatttctttattgtggatcctgatattattacagaagtaatatatgattttacttaatttctctggtacctactctccctcaaacaactctctatcccttttaatcacccctacccaataatctgattcttgtctctaagatagtcatacttttgtttaagaaatttccagtcctgatatttgtaaggttgcatattaagacccatttgtatgactggcttgaacttcatgtctttccacaaagaatactttgatctgtttctaggataccagaagagcacatctgcctttgcagaattgaatatggtttgcttattataagcccctagataaagggaatgtcaacctaaatgcgatggtacctagagaacagattctgttgagtgtgactgaacaatgaataaaagccacacctagtcaatttgggtggaatgcttgctggagcaggcaagtttgttcactctattaaacaggtctgaattgacatttgccagtataaaagtccatctctgaaagcttttttttggctttattaaggaagttcagcaggtgaaacaaaaggtgtgactccctagtatttttcaatgcagtttaagagagattgttcctgatgttcccagcaaaaaagtataagttgaagtatccccttgccataatcatgaggcaaatacaaccactgtagaagaatattagaaagagtaggcacagtggattaccctgaagcaaagctaatgttttaaaattttggttttacaattagaaattttagttatgaggaaagattctccctactgaatgtggtgtatgtatttataaagtgaatatgatattacaggctgttaaaatgttttatttggacattttgcatatctacacctgtccatatccaaactaaaggaaaacctgggaaattcccctagtttctctctttgaatgtggtgattcacatggaaacagatcctgacacacaggtgaacttgactcagtagagtgtattcatttgattatttatatagagattgttgattcagcacatttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcattttcataattctgtttaccaaatatatttctcataaacaggcttatatgtttatctaacattaatatagtaaggaacgaaggtgatgtaatgcttcagaaccaagagaaaaaaaataatagaaagttcaaataggtacgaggaagggagatatactaattaatgaatattatttttagactcatgtttttaatgttgtttttttctcttttactaaagggctacaatgtattatattacttgggtttatattacttataaacttaggactagaacaattttaagtgactggagataaaattggaaaatatttatttactttttaatttttttttttttttgagacacggtatcactctgtggaccaggctggagtgcagtggcatgatcatagctcaatgtagctgcagacttgtggggtcaagtcatcatcctgccccatcctcctgagtagctgggactacaggtgcacatcaccatgcacagtaatgttttttaaaaattttttgaatagaaatagaaatgtgatctcactatgttgcccagtctggtactgatttcccagcctcaagcaatcctcctgccttgacctcccaaagtgctggcatgcctggcctactttttaatttttgtaagtcagtcattaaatgatatagtacttgaaaacaagaggacaaatattcatattagacttacagttttttagttcacataaatttagtttattgactgaaatatttatgctataaaaaagagtagttttgtcatggctcttttattaacaattattattttaaaaggtgacccagacattatgtaggtttaatagaaaagaaaattatgtccatattctaaattaccagtctcatggtcagtacagaaattataacattttaatgaaggttctgcagcaggtttttcagttcacctactcatgtaatgatgaatgatggcatttagttctttcatcttgatgtggtgacattacatgttttgtaaatgatttttgcaaaattttcaagttaggaaagacaagcattatgtaattataaggttaatatgctcttaatataattacaacagtcatgatcatgtgaacttccgcattgaggttgaccaaatcatatcacagaagtgcctggagtgctaccatgccatgatcatctggattttactacattttctgaaagattagacaaaattttacttttaggtatatcaactgaagcctactgtaatctgtttgttcaactaacattgtttttaaggtgtacttaccctgagactaacatgaggggtttagggatgctcatttgcatggtttccttccaaaaccctgagaggggtcctagcaacgtgtttaaaatgtgtttgtaaaatttgcaaaatatattcgtgtgtttcattcttaaggctccacttccccacccagtggtctaagcttcagaccccacatatcctagatttgctcctcattgcaattactggtccaaagtagagtagttattcgggccttttgctaataagactgtgtatgtcacatagcttaaagcttcttttacgttaaaacaaaataaatcccctagcagtccctttgctgctttgccccatctctgttaatagacactgtgaaatctgcttttttcaaaagttgaatgaaaatgctacacttttgcagccaaacagaggacacttgtacatgatatcttctttattttattttattattattatactttaagttttagggtacatgtgcacaatgtgcaggttagttacatatgtatacatgtgccatgctggtgtgctgcacccattaactcatcatttagcattaggtatatcttctatagtgtccagtttctttgatagtcacaaatctcaacattctccctttatcatcctttatatattcccgtgagataaattacatgtaacctcctctattttgtgtccttctcctctggggctggttagctcagttagttggagcctggtgctaatgagaccatggtggcctgtgagcttcactgttcgtggtcacagtgtaagctacagccagctaccttgagattgcttgctgttgatcacaaatgaggtgaaggctgggagtttggtgggctctgtgaatttttttttttttttttacctgcaggttggtatggctcagtaatttgtcaatgagaggagaccttatataaaaacctgtggctgccctaccacctgataattaaagtggtacccccaagcatttctaatttgccttaatatcctgtaatcatctgttaaatattcatttacacccttctttccgtggtcttctctcttgaaccactctggataccagtcacattagcaattcattaatcacctggattatacacattgtgaattactttgtgtataaaaaggtgtgaattactttgtgtattacaaagtgtataaaaaattactttttatacactttgtaataaagttacatatttttatctatagtatcactaaatcacttttttttagaactcttaattaggtaccttctagtatggatttagccactccaattttaaaaatacatacacatatgggattcatgtatgtacatatgtacatatgtatgtataaaataccctgtgcttttcatactgtttgatctagcaattcatatctttatcaaaagacagcttaggactagccatctgcctaaagtcttcctcagtggagaacaagactgaaggatttattcaatttctttgccaccatttttgaaactacttttacttctttttgcactctgatttttaaattgggttgatctatttagtaaatcaaaaattaattaatggtttaggaatccctttttattgaattcagtaagtattgagcatatactctgtgacaggtatttaaatgagtaaagggtggataaaaagatgatcaagaaacaaactctaccctctaggaattcgttatgtaacaaaagtaagatgttggatgaatattttctggtccccttaatttctgatttgtacctgattcttcatatttttgtagctttgggcctttcttttttcaacatagaattatctttctattagccatgcaaggttctgttttggtttgtgttgttttgatggtggtggtggtggtggttgtggttggtcaaacccttgataattttaaactcttagcctacctatttatctaactttcactgacatgttcataaatagtctccaggtttcctgtgggttccttgctttgctcagttcttcctatttatctcccaaaaacccacattttgtttataccctttgttaaaactagataaccacttaattctttgaactacttcaatgaggtatgattgacacacaaaagctgcacatgttcaatgtatacaaattgatgactttggagacaaacagatgctcatgatactattactacaatccatgccacaaacttgattttttaaaaaataatctttgtttcctactagaatactaaagttaattgaattgccattattattacacggtggtcaccaacaaatttttaggtcaattcctgttcacctcctcaggaacaatgtcaaagttaccctgcttataagtgtcaatcatttgctctcttcctaggtgatgtgctgatctgtgtttaggtactcctttatgattcctggcctgctgttgtatttctcctcccagcaaatatgggtagctctgaaccatgacttgtgttctcatttgtgttattctttatacctcttatactcacaatcacctattgatctttcaactaacctgcctgccttcaatggttcctcttacttggagaattctctgattaataagatcagaaaatccaggtctaggtgaggacaatggttcacttttgacccatgaactttttttttcttagctctctctagagccatggggacttattcattaacaagtacgattagtacttaaacaccactatcagcttgcatctgtttttaaagttaactctcaattattgagaaactaattaactagtctggaggttatgtgggtctcctgcagcctgcattttggccacttcagtccccacggaacattactcaaggagtgtggaaatgaccaagcaaatactgtgaaagagagattattcaattgtactctgtgtgaaagtgaagtctgatggaaactaaaattatggatttcagtgcattttgggattatctaaagatagaaatatgcatgatgaccgtaaaaagagccttccttttatattatataaatgcttgcaaatgagcaataaaatgaagatattatgacgctagtaaaatttatgagtgctatttttcttgtattaaaattgggtcaacaaattgttaccaaatgtttacccttctgtaaaagaaaatatctagtcattcaactctagacaggaactcagagatggaaggccccgattattctgttgaccttaggccaggattttgaaatattttacattcatccaacaataattgtaattgatcttggatatttttgaggtaactacaaatagatctaggctattgaggagacacaaagattgatttggcataacatttaattttcatttatttatactagcttgagaaataacctgttaagtcactgttcctaaagtgtgtgtaaactagacatttatttgaggcatagttttgcattgaattgcattgcctcagaatcctttaagagcaatctgtggtggcttttaaaatttttacctttacaggattccaactactatttccccattcttagtcacggagtagtgattgttctataaacaaatagttaaaaatcctaatcctaatattagtaactatgtaaaagaacattttagtgaataccttagtattggtttacaaagccaaacattttcaatttgtggaatcttgctacaaatactaaattcatatacatatatattcatatatattcatatatatatgaatatatatgaatatatatatgaatgtatatatgaatatatatgtatatatgtatatatgaatatatatatgaatatatatgtatatatgaatatatatatgaatatatatgtatatatgaatatatatatgaatatatatatgtatatatgaatatatatgaatatatatatgaatatatatatgtatatatgaatatatatatgaatatatatatatatgaatatatatatgaatatatatgaatatatatatgaatatatatatgaatatatatatatgaatatatatatgtgaatatatatgtgaatatatatatgtgaatatatatgaatatatatatgaatatatataggaatatatataggaatatatataggaatatatataggaatatatataggaatatataggaatatatatatgaatatatatatgaatatatatgaatatatataggaatatatataggaatatatatgaatatatataggaatatatatataggaatatatatgaatatatataggaatatatatataggaatatatatgaatatatataggaatatatatatgaatatatatgaatatatataggaatatatatatatgaatatatatgaatatatatgaatatatatttggtgctttactcctgaaagcgttggagaatttcattttttgaaatcatttagaaccaaggtcggtgaactttcttgtgaatggctaaatataaatattttaggctgtgaggttcaagatgcaaagttgagggtattatataggtacttatataacaagagaggaaacaaatatctacaattttttgtaatacagctctactaatgagcacaatgaaatttgtggatggacactggaataagagtttcctataattttcatgtttcactaaatattattctcttatttttttcaatcatttaaaactgtaaaaaacattcttagattgctggccatacaaaaacacaggcaggctgaatttggcttatgggccctagtttgcagagccttactctagaacagagattcttaaccagtaagtagttcataaccccacaccaggggtgagtgtcgtggggtccttgaacttgctgagatcacaagcaacattttttgcatacatgaatttttctgtggacagagtctgcagcctttatctgactcttggagaagtcctggactcaaaaaagattaggagccagtgttgtctagatatttcgttaatttttaggacacatttcctgagtgtctgatagttcctaagcaatctgcaagtcactgggaactcatgggaatttctactgtaggagctaatactgctagagacatggggataaatagttgtcaggtgatcttattcataaagtctgttgccaccaccattcttgctggttgacaacactcagaaagatgaaaatttacacctggttatgggagggacagccgtctcttttcaagtatttagtaaataatttaggttggaatttaaatatctgaaacatttaagtgttcagaccatttcaggctgtaaagataaatcagagtcagtatagttaaaaccttttcctttacaataaaaattaacccacagataggttcatgttagctcaactgacatcaagggctgagatatatatagagacaggattaaagttgcttattaaagctgagcttctgagcttgcaggctgcttgacttaacccatggctgttagtcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagattcgggggttttttcaagtgaaaaaattttataaagcaagaaggaacacatgcaattagtaatacacaatgagacaccaccagtttcacaataactaacttgtagagtcattattagaaatatactacatttagtcatgatttattattcattcattaagcttttaaaatgtatcattgagtatatctgtcaaccagtcattcactaagtgttgggtactataggggagatgagaactatcaaaggaataaaaccacattgacaagaaaagatacccacatgtggaacaaactggaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataactaaaagagtataattagagtgtttgtgacaccaaggaatgataaatgcttgaggtgatagatactccatttaccctgatgtgattattacacacagtatgcctgtatcaaaatatctcatgtaccctataaatatagatacctactatgtacacataaaaatttaaaaaacaggacctctgatttaaaaaaataacaaaatataatggaccatactaaactcattttaggtagatattaaagcactcactttttctaatttatcactttcttcctcaactccttgctgtgttccataattgtcagtgggccaggaagacagaagcacagccagtatttggtagtacaggtggggcctgtggtaggacaggcagccttacagccaagcagtattgatggtgaagaggaaagaggaaggaaagggactgaatgcaaaggccatgcctgtgtaaggaaacaaagaagattgtccatatgtgtaatgtcattggtgacatggtttttagggaataaagaaagagttggaggaaacacatttggaacagactagcagtgagatttaatttggataattcatgactgttaaaatcatgtggcttattttatgagcttaccaataaagttagtacgtaaagagatttgttggtttaaaagcaactcctctatgggaattagtatgaggctaaaaataaatcagaagaaaacaatagtaaattttgatgtggcataagtaattttgatgtttctgaaagaatacctctttgtgtaatgacaggaagaatctttacctctaacatctttttttctcttttaaacatacagggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggtaagaaaaggcctgcacttgtggcctgtttcagagtaaatgctttgtatattcctcaatttgtctaatatcctgtaaccatactcatggatggtcatgagaggaccttaatatgaacagtcaaggttataagctggaaaagaaagaacctatttattctactttatttactaagattttctaaagataattatttaaaagccttactaatgcttttaacctactgtgctctttctcccattttcagagtaagggtaaattatataatttaaacagtaagttatttttgagtgcttttatagtttcactaccctcaatatcctagagaggcagaaagttgcctctgctctgtgagccactttcatgggccctttgctactaacatccttaatgcctttcaaaaacacagcacttaaaagatagggtattaagtaggttgtaatttcctaaaggttaaggccacttttcctctctagaggcatagtatcaaggacagcagcctgcttagtctggggggaaatttctacgtggttgggagcagaggcctgactttggttttttttttttttttttttttttttgttgttgttgttgttttgttttgttttgttttgtgggggtggttgtgtgttttttgttgttgttgtttgttttgagatggagtctcactctgttgcccaggctagggtgcagtggcgtgatctcagctcactgtaacctccgcctcccaggttcaagcaattctctagccttagcctcctgagtagctgggactagaggcgtgcaccactgcttctggctaatttttgtagtttttatagaggccgggtttcaccatgttggccaggctggtcttgaacttctgatctcaggtgatcctcctgcctcaacctcccaaagtgctgggattacaggcatgagctaccgtgcgcagcccagagtcctgacttttaagttgctgtagaaagccagttttgggggaacagttagtgctgcttagtaatactgaaaggtaggaagcaggaaaaatatttgtgtaacactgcagtgtgatcactgagaaccaggaattctcgtgacttaagtttgccacagctgtccgttgttttgatgtgctgcttgctatgtctttctttttctccctggacctttccttgtgtaataaggcataacagccccagtaaaggacaaaacccacaggaaacctcatgttccctgggtgtggaaaaagcactgacatgaccctgaagcccaggagatgcactgtgagctaaatctcctcacaaacattcatagtttggactcccatgacagagactttgcctattcacaacagagagacacttattttcaaacatccctattaagaaggttttcctcataccgagttgaaatttatcttgctgcaactggaacttcacaaaagaagtcagtccctattccaagtgagagtgactctcatgtctcctgtctaagccaaatactgcaaattgctcccttttcctggtagtttatggtttcaaggacacagtaccatttttggactggctccactttttgtcagaactgaactcattacatcgtgaaggatctgagcaccaaagtagaacaaacttactttctcccttgatctgaacaacataatctgttaatgaatgttaaaaaagactttaccaaattctttttgtcttaaatgcttttgaaggggtaattataagctatgaaaatagcttcatatgcatctgtccatttctgattatttgagtgtgtttgatagaatgcataggttacaagtcagcctcaaatttccacgtagagagctaaatattatatcataggccttcaattgttacttgtgaatatcaatataaaattcccttttaagtaactgatcacagcagggtcttagcagtgagatcaagttggctcataagaatttgatagaggtaagattaaataaaggagggcttcatgaagaaattcaagctttttatatttttaaggattcatagtggacatgctttataaaagagacatttttaccttgttcatgtatatagctcaggttgagttcacagaaagcagcttgtatttaaaaaaaaaaagagagagacataaagggttgatacttagttcatccacagtctcacacctcttcggcaggtttatgagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaaaaaatgtaaagtaatgttaaacttctccaaagaatctgatccaggggcaagtttcacggagtattataagcacagtgggattttgaaagaactgtagacatgaaaggatggtttaaaaatgctaataggttttagaattaaaccttacaagaacttaacaaagcaaatggtacataccgaaatggacagcaagcctctataaataagaactgcatatattttgctaactatctacatagtacctgcgtgaggtaggtcgtgggggaggaaatattcatttgctttttccttacatgttagttaggaaatatataattataggacttgaacctgaagtctttgtataaactggattttattttatggggtgacagtgtcagactctgatctaccaacatctgttttatcacctatatgccatttatgtcctagatctgtattggagttttaacaggcagaaatctctttcctgctatatctgttgcttctgctaatctcatttttatagattcatagatgagtatccctgagatattaattataaatgattgtttactgtagtagctttctgtcatatcctgcccaaatgaggtctaaattagtgaagttgaaaacctttttttttttttgcatttttttttgttttgcactactgctcatgtagttggactacctctttttttttttttttttttcttgagacaggctcttgctctgtcactcaggctggagtgcagtggtgtggtctcagctcactgcagtcttgacgtcctgggctcaagcaatcctcctgtctcagcctcccaagtagctgggaccacaggcatgcaccaccatgcctggctactttttctattttttcagagatggggttttgccatattgcccgggctggtctcaaactcctaagctcaaacaatctgctggtctcagcctcccaaagtgctgggattacaggcgtgagccactgtacacggctgtgaacccccttatctctacatttggttaccttgctgtggggccactgcttatccagtgtcttgcccaatgcatacccttacggaggattcccaggaaataccttatatgactggtgcttgcttggtttgagtacatttgttactttctctagtactagtaccatctctccccccacaggccctgcagcctggtacactgcaactgataccaaagagatcagcactggaaaagcccaatggtgccaccccggtctttaatcccactgttttccactgccaacaggctctgactaacctgcagctcccacagccggcatttatccctgcaggtgagaacacagctctaggcactgcagcgagtttggtgatgttgtgaatgtatacaatgcaaaacagctttcaaagagcttgtataggaggactgtcgacatgtattttgattaaaaataaaacaaggaagttatgcttatctgctagtatctagaactacttgtttttctataattcatgaaaattcatggtttgaaatcaaactaggaaaaagtatcaacatttttctttttagcatttgttggtttttgcttatgattaattcacttggttcagtctcaaactaattccttgactcttaggtatcactgtcacagacagtagagtgctgtcaaataaaaaggcaaaaactcccagcttcgatattatggaaatgcgttgtcaatatgtctttgatatgccaaaggtagttaaaataaaactaccctaagtgcataatatagtataatatagattaaacagatagttttagcctgtaactcctgaatcagttaatataaaatacatagcagtttatattttctgacattttgcagcatattttgttatctcctacattcagctatatttaatagcctgttttacatgaaattgaacagaaaatgttaagccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttttaaaaaataatttagaaatccttgttaatacccagacttgagaaaacttattggttaactagtaaattaatcagttaattaattttgaaaggtaccataaaacaccagtctttagttactagccacagcagtccttcatgccatcatttaaattatacaatttgtatacatttatatgatagtttctgagaggaaatatggaattcttcagcactttcttacatcccttataataagtaactactgatatctaataatttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagcaacataaaagcctgtccagctaagaggtctctcttaatggaacctctttgccatatattcatagtcaagtcctattgactatgagacagtggaggagacagtgttaacagattaatactctaaatagaaacacggacaccagatacgagattctggagcatatttagaaaatgatatgtgtaataaattaaaattctcttattataaaaattatttaggatgtatttgtccacaataaatatgtaatttaagtgagttaattcttttaaagaaaaattatagctgattttgtacctaagaatccaagaattattttgattacctgggtttgtgaccttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaatatttgaaactagccagactgggcagttttgttctttgcttaacatgtattatttaaaaattgtaaaatacttaaaatgtataacttgtaaagtacaatgaaacaattcccacctgaaaaagttatctataggacttaaagcattcaatgttcctatgttgcgagaggatgagttcagcaaagccagaggattctgcagtgttctgtaatgaatcctgtagtgttctagcctgaagcaccattggcacagaagctaggcacaacagaatcatttcaaaatgactctttgagtgttacgtgatttttaacaagcagttgcacacagatccttttgttagccactaacacaatatgatagccatctctaaaccattttatacagcactaatactgaagagcatgagaaaggaatggggagttcacagctcctacagtcctcatgggcacaaggaacagaccaggagaaaatagctctgttctatgcaaggagaaatgatcccaacccgtcccactctaccgtctcacatcaatccaggccatcccctcccttttgagagtttgcaacaaattgacctttgtcaccttggtggaccagaatagatgcagagccccaaaagcactactaacaggcttcttgagaataaagttcaaaatgacaaccacatagtagcagcactcactaacatagcgagatctgaaccctgggaatggaagtgaggcccctgttactgagggtttgactgtcttctgtaggaattaataaacatttccattaataccaacaggagcacaatatgtatacctttgaatcataatgtgtacaattagaacagacttctgcaagtttgagaaatgtgtctttgccttcatgttttgtgacagttttcttgaagatgctctcttgtcctttcaccttcagagctttgcttaggaatgcaaactgcattctttagtggatctgcttcctgtacaattgctgcactcccaaagggaaaacaagagtgtttttagaattggcatatgagacaacagggatggctctgggtaatgggtaactagagataaatggaagggataactatggagtttctgttaatcaccatttggggtacattttcagtttctatgacattgcacatgttaatttttctctggccattcattttctctttagactttcagaaaatctgaatttaattgatgtagacatgataaattattacatatgcatgcttgccattcacacattgccattcacacattaattccctggtttgctttctgaaatgagctagacatcagaaagcacccaaaacgctttctaaatgagatagaaactagaaaaggcaaagataaaacatcctgcaagagatttcacagctgctaaccattgtagctataatagttgctgtgaagacaagatttactgtgaagtactccatgtatttgtttgataaatggccaaagtttcccaggagtttgccagaggtgtacttaaaaacctgcatgcatagtccactgtattcttcatatctgcccccctaccacataccaaccagtctacctaccatgtctttgcatgcagatcaggtaagtatacatataactgcctgtttgcacctgcaaatctagtgacggcattcatgtccataagtcagtgaacctaaattccaatttatgattccttaattccattttgaatgtgcagtccagttacttgtctgcttaactagcttcagatagatagcccttgtaacattggatttttgttttcatatgcattcattatagccccttctgaaaatttagccttttgagtaaactacaatgggattctgctcaaaaacttactaaatgttgagaatggttccattttccatattggtaactataattggctttccccttttctctttttaattttccccccttccatgctgtgttgctttgcactgactgtgattgcatgaacaccctgatgtattcatcgttatgatgtcacatggcttgttgctgtgatacctaccacacctcattccatcgtaaatgttatggttgcataaatcctctaccctcccgtgtgttgcttctatggttttcaactgaaagtgcccatgatgcacggtgctacacctaccactgtgtctgcagcaacaacacctgccaccagcgttccgttcgctgcaccaactacaggcaatcaggtttggccatttatttaagctgttcagatcaagataactacaatgttttggtaatgcacagtatatgctttttggattggtgagattcttatgtgtttcttaagccattgtcacatttagaatttttatttttgtgtatattctagaatgctatatgtgctttgctattcatcccaagatgaatcagaggagttttgctcatttttaattggttaccagatgttgctcttgatattctatatttaattactggtaacacaccaatcctcaaatgtatatacttaatgttacttaaatgcttcctcattggtcaagagaatttatttcactgccatttttgattattgtgtttaaactttggcttagtacagtcatcacctttaccttcagatccactggagagaaaacaaaatatcacatttctttccaagacatggatatccttatcatttcgcagtgattacatcagaagttccttctcatatggacattagatgtgcttgttgttttgatttttatttgctttaggtatttctaggcagagttcacaaggcagattataagtttggggggagtcttgaaattataaggagatacatacaataattattgtatagtattagggccattttgccttattaaagtgggaaccatgcttatagactaaaagatccacatatataacaacataaacagaattctcccaagaaactattttaatctaaaatcttttttactactatagataccccaattatcaatagatgaactgaatagcagcatgtttgtttcacagatgtagaagttctcagtagaacagtaagtttctttcagtattaatataaataatatttataggctacatattttatttacacaattgcacttctaaaaggctttcgtaaatattttcattcatagacattgcttgtgatgtagagcttgatttacacattataaattttccaaattgaaatgtgagtgcaaatatgcaatattttttatatggcaatgacagctggtactgtattttctcaatgagctaacacattcttaaatgttttcctattattaaaggaatatataatttgttagccagaggcacagattacttttgagttgtaattctttaaccattttatagcttcattttttttttgaagatcaaacaagaattttcaggatttgactgatatgattatgttaaacacagtaagcactatgcctgtcatgtgacattgtattgaattttgagtgacataatttagtaactgagtcattattttcattccaatcatgtctcttttttaaaatttttgttgttgtgggattttttttttctccttcaccctcaatctcctctttgcctggtgcccatcatggcacacacttttttaagcaatcattcacttaagaacatgtgatttctgaagccacttaagactcctaggtattttaattaattctagggacttactaaaatagtgtaccaactctgaattgcataccttcatcatcgaaagtttgaagttctcacacctggagtgtgtcatttggttgaaggaggcagcagttctgttccctcgtgaactagttccccagaccccagctagcccttctttcctgctgaggacacacgggcttagaacactaagtgttctggacagagcagatagccgactggacattaaataaataggtctcctcaatcataaggaaggattttaaaaggcacctttgagcacatgggataactgaaggagctataaattgtcattgtttccagaggtgtcatttgggatagtggcaacttggaaatagcactaaacatgataatgtaggttttgccaacacttgcccaactttcatgggctgctttacgtcaaggtaaccacaagttgtcaaattaactttccaacagagcatgttagggaagagtgattccttcttgcttgattttgttagaaatgtagagatatttggcagaacataatcacttcaatatgtaataggtgctaaaaattcctctaaagttcaaaaatgtaattttgtacaatacaatacccagatttcacaggtaggctacttctgcatggctctaaaacattcagagaaaaagttgaaagtgtatttaatatttgcatatttcaaaatgttcggtatcaaacatgttttctcagtacatgcctgttgaaaggtggacacatgggtgtatgttcaacaaaaagtagatagataatgccttaaacattggattgcatctctgttaggacagttctccacattagcactcaaagggtatcatagactatcatagatatatggttctttcatgatcattctcaaaagccccatttcaatctgaaattcagattggggatattttggcactgttaacagacagaactggaacaagacccaccacactctcctgactcttccttcaataacctttcaatatttctcactctttctttctttctttttttttccatttcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaaagtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcataaccaagcctcttttatgcttgtttggattcgtttgcctttatatatgtttgaaaatgacaatagaaagggttttatcaccctttgaatgagacagagtggctatactccacagagctcagctgagttcacattactaatatttatgaaagaattttacaaccaaataattcctgtggtgtgtgacatatctcatccactctactcatttattaatgttattatacagtggtggaaacacatgacattttacatcaagtaatagatttaatattttctagtaaataggcgctcttccaccagaaagtataaaaccatcatatacatatatatatatatatataatggtttttctccttcatgaaaatgacaagtaaaaagcaaatctgattgaggataccttaagctggctagaagtgtttgaatcacagaacaatggaattagcaaaatcctttttatagttgatggaactgaatccaggggcatatgacttgcccaaggctaccttagccattgtgggacccagaaatatctcctgcttcccattgttcctccttttcacattgtttttgcttcagaacatttgatgctctcttccaaagcagacccatttggctcagaatataagagagcaaaattagctttctgggaattgatactctgttgatcttaattatccatccaaatcctgatcaacagtgctttctaaacagccttgcttgtattgagtcattgtcagctgttgacaatgttgcgtggaattagagatcaagagttgtcctgacctttacctatggactctttgaaccagttaatttctatttctgaaatcttaacattgctatagaagaaagtagtgtatgcctttttgaaattcatcatgtatggaactgagttttgtatgatccgtgccagtgcctctccagaagggcagatctgattacatgaatccaggagggatgcacctgagctagtctggatatattccttaaaggagacaagaacttttttgtgcaaaatgaacttttgtgtagtttgacatctgcatgcagtgaactgtctcacttaactttttcaactttgggcaaagatatacataaaccatagataatagacctacagtacagctgttttcatgttgcgttaagcactggaagacattaacaatgacttaccttaaagtaaaaggttccgtgaggggtatttagggccactgtatttttggtgccacaattttctacattgttggcattttaaaagttgttttctaaatgaacttaaagaaagaaagctcaaagccctaaagttttgatcaaattcaatagagttttcagaaaaaaatacaattttaagatagcactctttaaactagatgtgcaatgacttattcaaattatctttattcaagaaaagagaaaagaagaaagataagtcattagactataaatttccatttaaaaagacaagtcacaaaactaatcagtgactctaaacaaaaatttactggatgaattgtatatataaaattctaatcacttatgattcttagttaacattttataagctttgtattttacaggggcctctatttatccaaatttattgtttttgtccatttttctcagccttttgcaaaaaatatgcaagagtgctgaaacttggataaaacgggtcatgtatacagagaaaataatctaaaagttatctttaagagggttttagtagtgtcaactttttaaaaaagtactatgtgaccataacatacgtatattttaaagagggattaagattaaattaaaataaatggattcataaaattgctatttaaatacagtatttacttttgtaattgaagcatgattccacaaccagctgtggcattttatttcacttttctagatcagaggctttaatttgtagttaatcatgatgtggaaagtcatcttctctctactccatcaatttttttcatccgtttttgaacatgctgaagcactttgatcttgccataagtgttgtcctataccactaggtggtgttcactaatgggagggcctcagctcaccggctctccaatttgggaaaaagcaagtacctcctccctaccatcagcagaaactgaatgaaattaatctttgcaacttgaatctgttttaagtagcattaccaataagcatagtggtatctgaataaggaatgacatttacattacattttattaaataagagagaaagttaatgtgctacttgaaatgttatttggttctttgtccccctcattgcagagtatagataaggatgctcttaggtaaaatgcagccacaagttttccgagttcctttagtctgtagggtaggctatgaggtacagaatgattagaaactgaaatcctcattatttttctctcaaatacatttcacatacattgaaacagaaataggcaaaatttatgagggaaatctgatttcccaattctgatgaatagatatactaagacagtagccttgtttaaccagtgcctgtagaaggcactagaataaatagcatgtccaagagtataacaactttttttgtaaatttagttactagcctaatcaaactgtaaatataactcactaattggtaccatattttcatttttcttattgttcatctttaaggtttcattttattgcttttttgtagctctaagtaactaatcaatttaatttcaaaggaaagttaaagaaagtttaagcttttactgcatggattctgcccgcctagctaggttctgaactgacactgaagtatgacaagatacagattatagtccaaaactatcctttacagttcacaatttaagaacaaatttaactttatatacaaataataattgttatctaattatatttagttgttgctttggcaacaaaattacaacatggctacctttagacatttgtgtatgtgaacattttacttgtaaactataggtgatttgtgacagtatgagcctgtagaaaatacagctcaaaactatgaaaacagacatggttgagttcttttttaatcccaaaggcccatatataaaagctgaatttgtgtccttgtgtgactttttgtgaaaaagtttataacacatggattctagaatcaggctttatagtttatagaatttgttgtgtggatagggttattccacagtatttagacttcaaaacgcaatcattgcatttttaatacattacctaactttttttataacttaattcaaaattaccccattcaagtggcatagctgtagctgcaaaaattctgttttctggaattacatgagcaaatatagctatatgaggattaatgtatgactaaagcctcttttgaaattaattcatatttttaaaactatacataaagatactgtggaatgaccccttaacagtgtttaagaaacatatgctgcagttaattgactgtctcagttagggtgcggatgtgtgagacacaccttttttgcacttatgtacatagtccatgaaagcaatccttggagctttttttaaatgtaagaagtctgtgataatagtggaaaagttagtaagagagagttatttctaaggctttgaaaaggagggtgtttttgctctaagacttaactaaagcataatgttgctttgctgttacggaggctttctagtttgctacaggtcaccaaaagagaaggctagtaacaggtaacaggtcagcctcagctaacagcactgaacaagagtagaataacttcatcttttaacaagatcattagcaaagattgtttgctttttaaattaatcccccctataaacacacacacacgtgtgcacacacacacacacacacacacaccgggcagtttctagaacaagttttcctttttcagtggttgtaagcagtgaaatacctcatgtattacaagatagatattaccgttatgatagaataagatttcatctttcacagaaagtgatcagctgatatatgtgtcagttaaaatgtttatcaattaataggtatttaagtgacaaattgttaatgttgaccattgttcctcctttaagatccagtaaccaaaaccaaatcggtaaccattgaaagatgatatttaacagttaaggatggccagcatagggccgttcattcccttcaacaaagggaaaaaaaatgctcctggcacaactttataactggcttcatttacattatacctgttcagtggaagctgttttttgacctacctttaccagattacaaagtagttaactgtgccacttcagcctcccactgttttgttttaactaaacagaagagaaccagccaaaatcttacgtaacacaggagctggaagacaatgtttcaatctgaccatctctgccaattttagctcccacgccacctatagatagccagttaactttctttttgcccccaggcaatgaggcctagaagaggtcaaggttagaaaggttaagcatttgatcactacaggtacttgtagtacctagagaaggaacccatcctggggttggtggagttggtattgctactcgttttgatagttctcatttacagagaaagaaaaataagccaaagccagaaagcaatccaagccttacagttgtccaatacctcagggccagttggctagaattttcttttccctcagcccataatcacttagagttagccatacaacaaacagcctgacaatctgaccagcatttccattgatataaaatgtaagcattccttcattctgtagttaggaactccaacttcagccttatctccaacataatttcccaatttaacctatgtactgatatggacatttctttgtgaatatgccagattcaagaatgtatttttctaaggtcaatagagatacgacattttaagtcaggaaaaatcacctataaattagtaggaataactgtagaagcatcacaaaagataccccatgaatagatggcatggtgtgcatgctgacagccacggggtcatactctggagtttcaacatagaggctgtgtttcaataaataagacaaattggggaattaagtaaaacaaatggatgtaactgaggcccccccccaaaaaaagccctctattactaacctcaagaaaatatttagtttgactaatttgtgcagtttccagctcttctacttgttcttgcctgtaagagaatcactaatactcaaaagctggattattgaagagaaattttatctttaaatagaatccatccacaattatggtatatgtaaaaaaaatgtatgactatgaaataagtcgcagctctttgcagatattgcaaaatccttgctaggcatctacatcatattagttttttaaaaaatacctctgtaacaagacctaaaagtaacctaactattaagcagtgcttttttctctgaaaacacacaacctaaagatttatctgtcataaaactgcatggttccagagctttatttctgtgtagagatgctatttgttagtgatggaaacaaattactttgttgctatgtcttttgtgtctagcagttgagagaatgatatgaccatcatatcactggattatgggaatgaatgcccttttcaaaataaacttatttattaatattttaatattattttaatattataatattaataatattttaatattattgttgctgctttaacagaaaatgagccatttgtccccatgctcccaaattacaatgatttaaattaaaaaacttttgaaggattttcctaaatatattcttttttaaaggactaactttgtgcattcatataacaacaatttggaataatgtgaaaaatggaggcacataatttgggtggaaaatggcgattaaaaatatatataagaaaattattagccatgtgtaacatatttaaataatgaccagaatatttcatgagtaccaactcttcccatagtaattttcctccaaaatgcaatagctcattccctcaactgcagacgctttgattttttttcaagttatagtgctgtagtgcttgtttatgtttaaaagtgcacattatgcagctcattttagtatgctacttctatgtttattttttgttcttctaataaaatgcataaacttctt

SEQ ID NO: 3717 - DNA, 60486 bp, human
aattcatttttaatcctttaatagtccacagtaatattgtcctaaagagggtacattggattttaattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaaggtgagtcccatctgaatgcacataatttaaatttgttgatttctatgttttttgaaatatgatgtgctttgaaatgagtaaaattaataatagcatgaaagtgataaattttgtttttttaacaaaaaaacagaatgtcaagatagaaggtcttaaagtcagaatgtcttaacgacaaaatgtcttaagtctttgtgtttgtagagctaagccaagtctaaagctcattccaccaaagaccacttaccacttatcaaaacagatatacttaaagaataaaaattgaagaatttttgtaggagtgagggattgtagccttgctatcgtttacttttttgtatatgatttagatgttacagtgatcataatccccatgtaacctagagaagcccttcactgaattatagcatattatccatagtaccaaaatgcacttaggagggacttgtcagctttcagaggataactaaagtcagactgagggagtataagggttccagaaggaaaattatggcattttgaagcgtctcaaagtatattttgaacctttaacttaaacgtattgctacaaaactaggttcacttaattttcctcctggacagatgattgaccaatttcagatttgtgagtatattttgtaaggaaagtcctattactaaggtcatcaagcctgagtattacatactagattataaacaaaatatgaggccagatgaggtattatataggacaggatgtatatgattgcagaaaaagaaaatgcactgattttcatgtgttattcatagttatccttaaattaaggataaaaagtataaattaaaacatagaagcaataaattataatggatttctggtttaattaagatttgctacaatgcatctgagacttttttcaaaatatgtcaaaatgaattaagcttaacaagaactttttcagtttcttgatattgttttaccttcatcatgaccaattttacctcattaacatttttatttatggctgcattggctaacagagatgtatcccttcgtgtgatggtttcctcaggaaacattttcttaagcgatatacaggttaagtatctcttatctgaaatgcttgagactgaaagtgttttcgattttttggattttagaatatttgcatatccataaagagatatcttggggatgggactccagtctaaccatgaaattcatttacattttatatacactttttacacatagcctgaaggtaatgttatacaatattttaaataattttgtgcatgaaacaaagttgtgtacattcagctatcagaaaacaaaagcgtcattatctcagccacccatgtgacatcatgttgacacttaaaaagttgaggcttttggagcattttatacttcaggtttttggattaaagatgcttaacctgtagtacttaaagggttacttttacttatttcgtgattactagttttttgttttttgtttttttttgcagaccattccattttaagaatagaaacttgttattgtaaagataaaggtaattcctaccattgaaaatctctgaattgcttttatttgtggtagacattatgactaaagaacttattttgttttcttcattttggtttcatttaagtttcatctacaattattttgtgtattatttaaatctgcagctacaggattgggcagtgccttgaagtggaaaagcatactgagttagttgggggaaaaatgaggtatctttcatctggtccatatagagggtcaggaactgcagtagaaactttgcattgttgtttcaggagatctggggtacagtcccagcctcactactgtatctgacctcgggcaacttaacctcacaatccttgagtaacttcatctgtaacagatagatagtatcttctgtacctaacttctgtgattattgtggagattgcagtaagctagtacaaatggaaaaccatatatcaatataaaagtgaattaaataaaaggttttcttcctatcaactaaatgtttgttgtaggcattctttaacaaagttctatttagttagggcttattatttaaaattacaaactcatgttccaaatgtacatgaccaaatctagttgctgtgtgttattagttgttcaagctaagtataactgtttttatggttactctgatatagagttccttgcaggctttgtaaattctatctttccaaacatcatagaatgtgaaaggagacatgtgatcttcctaatcattaataaactcaggtcagtaattccatttaaaggcaaaagagtgccataaactaaacattttgaagaaaagtactagggaaggtgactgtttacaaaatgcgtgctgcactacaactttagagcttggaaggtgtttaattcagagacaaaatagataatagccaatgaatattaataagccacttaattatttaaataagttgtctactcactgtatctagtgtttttaaagtaatgtttgcatcatgttaatatcctgatgaccagtcacacagggtaaagatgatttacataatccttacattctcatattttagtgaaaaccttaatatttcaaatatgtaaagccgttcaaacaattacttaatttgccatttagatagcacattaaacaaagttccatgtctgcacaagagctttgtagttcttatccatgacatgcatgaaggttaaattaagttgagggtaattgacctatgtgcattgtgctagtatcatatctataatatacaaataacatacctcagtggttactgcagcatttcctacttctcctgagtttttataattgaaacactgttgaacttcatctgtgtactatttcttctctcatgagtgattaaataactgaaacaatcatttgatgagttttgggctgctgcttttgtttttgttttgttttgttgttgttgtgtaagaattctattagtactagctactctaccagatgatggttattgccttaataacaggtacaacagatacaatgttctaactcacctcataatgagggaatgttatgaaaataagaagggcaaattggatggctgattgtgtattgtgctgaagtgctgtgcctatcaatccatgaatgttgagtgctcagtgatgaaggcagcaccatcttcaaatggaaatctagtgtagtccatggattaatttccagctacatagaatggtctcatatcatgttggtatgcagctgtttttgactctgttgccttgtggacttggcataatctgtctccaaagttttcttcaaagtatcgcttaatccattctatgccaatttcttgatattacagtttgccattgatctaggttggtatttttagtgaatgttccttggatttaacgaagggtcatcatttttaaaacgaaatcaatctttgtgattgttttcatagccaagttattctgcttcagcaatatcatgatgtcttgaacctttccctttatacttgaagcaatgtgttatcagtcactttttatccaggaaggatataaatgttgtcattatttcattatgacagatcaacacccatcacaactgtccacccctcttaccactttgggtagttttgtgccaagaatttcctggtaaaggccatagcagcagacatagttagaggatactcaagctaacctatatacattccttaaaaaatgggaactgggtaaggaatgcacataaaacagtcacatgccatgtcttcaaaatcacatatgatcacgagaaaaataatattttgacaagtgaaaccttgtcaaatattataagcatatcgatatgaatctatccttgtaggtcaaactggcccaagttaccagtatattctgcaatagcaacactagtcacagcagttttcattagtttaaaatttgactatttttgactgaatacttactcatccctatttgccaagggaaagtttaccagaaactagatgcctagcaacacaatcccaagggtcactggattatgcaagacttagcaccatttatcagctccatcagagaggtctgtctacactataaagacacataagcagcagctgtcatcttgagagtcaaggaaaataacattttatttaaggatctctattttctatgatgctaacctttaaagggaagtatctttgactggtaaaagtcaatgctattttggacatttcaaaaacctcttttgaaaggaaaatagaattacaattataggttggtgcggaagtaattgtgttttttgccatgaaagcaatggcaaaaactgcaattacttctgcaccgacctaatggtacccaaacaaatacatattgatagttcagcctcgccttttaaacattttattttgaaatattaataattttaggcttacagaaaagttacaaaagtgatacaggaaactcctgtatactttttatccagattcccctaatgtcaacaacttacatgccatgcattgcacagttatcaaaaccagggaattatcactggtacaagattcttaagtaaactcaagaccttatttgaatgtcaccaattttcttcctaatgttatttttctgttccaggatccaatctgggatcccacatggcatttattccttatatctccttagtctcctccaacctgtgacactttcccagtctttccttgtctttcatgaccatgacacttaggatgaatactggtcagttattctgtaaaatacatctcaccttgtgcttgttgaatgttttctcatgattagactgagatcatgtggttttgacaaataaaaaagaaacccacacgcagaaatgatgtgcatgacatctgagggtatgggatattgatatatcttattcattatgttaactttaattagctggttcaagtggcatctactggatttctccactgtaacatgaccagtttttcttttgtaaaaactgataactatgtcccccatttattcatcatcccctacaatatgccattgatcgtaatgggcatcccaatgtcctagatgttaaaaagtgaacaagtgttcatcttagaagtgattggtaatgtacttctataattatagtcaattaagaaagagagcaagggaaaatggaccaagagcatgacagagaaaatagcagcaacaagccactggaaagacagaacactggagagtgagcagtcctagaagtgatgtgatatgtgtgtgcctatcatatactactgcagagtgtgacagctgtccccttcttgttcatggccttgggacttagccgtgaaccagaaacagtccctgcctccatggtgcagacattctcattgggagttggaggaggagcaggtaaaaaataattaaatattcaggataacaatacattgtcaggtgtgaggaaagggtgcagagaatggcaggggctactgttttagatacagtggccaggaggcctccagtgaggtgacctttgaggagaggcatgcaggagatgaggggacagtgaagaggatttctaagaacattccaggcaaagagaatggcgacagctaaggccctgaagctggcggcagcctggtgtgtgtgaggaaactcaagatccccagcgtggctggagcagagccatgaagggggagggcagtgggagatgagggcagggaggtcccgggggtggggagatcaggtggggctctgtgtatcatgctgaggactttggatcctgttccaggagctggaaaggttgacataatcgggggaaagcaagcccacacaaagcagaggtgtctagtctttatattttttaagtggaaaagagaataatttccacgaagacaaataactcctgtttataggtgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagacattccatacatgcctctgtagtttgctgctagagagagagagtccttgtgcatgtggcttcgaactaggaagaacattggaagcttgtgctgggcttctcttgattctactgatacgtatatttttcctgttacttttcctctgtattccaagctgtaataaattttagttgcgagtgtaagttgctattgagtctgtgagtcctggcaaatgtcaaagaagcttttctgtatgttgttatttttcatacattatttgcttgattttttttttttacatttttctgttttttatgagaagggctttttcattttgtttctattttttaaagtttaatttttgaatggatattttcataattcaaaaatttagaaaaacagtcaactaatgagtacatcaacaaaatatggtatatacatacaatgtaatattactcagctacaaaaaggaacaaagtactgatccatgctacaacatggatgaaccttaaaaacatgatgttaagtgaaagaagccagacataaaaggtcacatattgtgtgattccatttatatgaaacatcaagagttggcaaatccatagagacagaaagcagattagtggttgccagggtcttgtgaagggcagtagatgggtgagtgaggggtgaggggtatgggaattaactactaatgggtacatggctttttttttaagggtgatgaaaatgtcctggaattagtgatgatagttacacaactttgtatataaatgtgttaaaaactactgatgtgtagactttaaaagggtgagttttatgatttgtgaattatactcaatgaaaaagtttaagaaatttcaacgatagtagagtatgcagcgaagttttcccctcatctcttttccccagttaatcagttgacctccaaactgatattttggttttccctctcccatagatattatatatatacatatgagcaaatatatccatacttattttccattttcacacagatagtagcatactgttttcctccttgctttttttgagtttaaaatattaacagtaaaaagatgggaaaagctatgtcatgctgacactaataaaaagaagcctggaggtgctatatttataataaagataaaaagaattgcacacaaatacaggattctagttagtaaatctgttcctcacaggcatatgtaagtatgtagatactgaggttgaacaaataaatgtatatagagtagataatgagagcctattttctcactatcagaggaaaaaagttaaaaataaaaagggaaggttaggatgaataccgtggtgtggattagaaaggacacatgagtatgtatacagatagatacaggaatagatattgatctgtgtgtatgcatgggttattatgtatgctttcatttcctagctctgtcttgggaagccctagaagcaattaacaccccaacagcaacgagtatacttagtacccacatctttgtgtctaatatcattctccaataaaggaactcgggatctttggaataatggctaattctggacagaagcagggaaaatacaagatgaggctgtaatgtcttttggtgtaagaatgtaagaaagtgctagagaaagggtgggggcatgacaagacagcatagtagccagtctgaaggagctcccaatggctgaagttagaataacttgagcaagaaactaaatgatgacagtattgaattatagctcatagaataaaatagatgcccatgagtccatagtttacaaaaaaaattgaataaatggataagttggggagaagggacaactcctccttacagaagaattccaattaataaatggagaacaaatgaaggaaacacaaaatcactagtaggcaaatgccatggtaataatggttgcaggcaagatccactgatatatgctgaaatcagtgggtaaaagttggaggagaaacaggatatttgcattgtcccaaagtatttctcccaggatatttatcaattaaaaatagaacaggcatggtctatttcatttatcaataaaaaatagaccaggcatggtggctggctcatgcctttaatcccagcactttgggaggccgaggtgggaggatcttttgaggccaggagtttgagaccagcctgggcaatatagcgagaccctgtctatacaaaacatttttaaaaaaattaactgggcataatggtgcatgcctgtagtcccagctactcaggaggcagaggatcgcttgagcctgggagattgaggctgcagtgagcagtgattgtgccactgcactccagcctgggcaacacagcaagaccctgtttctaaaataaataaataaagggaaaatagtcactttacagtggagaaacccagcagatgccactttaaccaggtgtttaaggttaacataatgagtgataagatatatcaatatcacataccctcagataggatacacaccatttctgtgatgttcctgccaaaaagacatggtctcggtctaatcatgagaaaacattcaacaaacacaaagtgagaggcattttacagaataaatgaccagtactcatccaaagtgtcatggtcatgaaagacaaggaaagacttagaaagtgtcacagattggaggagactaaggagaagtgaggaataaatgccatgtgggaacctggattggatcctagaacagaagaacattaggaagaaaattggtgacattcaaataagatctcttgttaagagtctcgtaccagtgttaatttcctggttttggtaattgtgttatggttatgtaagtatttaacagtaggggaatctgggtgaagggtatacagggactccaggtattatttttgcgatttttttgtaagttcaaaattatttcaaaatgaagtattttaaaagttagcttttttagtctgtcctttgaggctcagaaatattgtggggtattgtttcttttcatttttattcttaaaaaaaaaactttgagtatggggatgagaaaactctaaaatctagtcatgactgatcatgagattgcccccaccaaaagttcgatgactcagatatcttcatagttaagaaagcgctcatacatataaaagcacttcacaaacctagcaaacgaagaattttggctgtagaaggaagaacgttcagttcaaaattgttgccatttacagttgggtaaactggtgatccgttgagggagagtgacttgacctagttcacatatgcagttatcaaaagagcttgatgactccggcgttcttccaatcattattcagtcttctttcctgtggagaagaaggaaatggagagaacatcaattaggctattgctttagtaaaccaaaagcatccagctcttatcacagtcatgctgctccacatgacattgggactgtctgtgaagttttctggttctcctttactttttgcactataaagtaaggcgtggataagccaacttttcctttgctaatccctccctcttttattgtttctgattcatgataatttagattaagactttattaaccttcatatttagttcatggacaattatttggataacttgttttgaaaataaggcagaagagaagaatttttagacaaagttacctaactttgtgatactaaactttgcttaattgctgagtgtcagaacactgagctgtctctgctcccttgtccatccttctccccaaacaccgcattgttgagtttgctgaccagaactggggattgtaactgtggctgtgtatcacatcttcactgcatgaaactcattgatgtctgattctgttatatactcattagtacaatgccctggccagctaggaagaaacctgtcatagatcagctgaaatattgcagtagcaattcagccttattatgggtcaagtattttatacaataatttggaatctaatccaacttatttaaagtgttgttttatgggatcatagctcaaaatcatctcttcctggccaagttgtaattgggcatctggtgagaaaagacttgggctagggccaggcatgtattccccaactactgtttgatgttaccattaatactgaccctttgctacaggaactccattaagtaggagagatttggaaattggaaatttgaaaactattatatttcaactcttttgtctagaagaaactcttagatgttagggtaatatacatctgatcctacttggttagtaaataatctcttcatgtagcatagctgaaatgaagtctttttctctatatcagattttttcgaaatgtggatacaaggtacttctgtgcatccggaaatagcaattagttcttctaggaacatgacattattcatagaacattgtttacttactgttctgtttgcccttgcagatgacctttctgcatgtaccatccttgaggtgacccttgttttcctctcagtgtgtcacttggtccctgacttatggggttatatattccagaggaatcttagctgtctgctattttctgtaaatactcttttttttcttcagtgtttattctgctacataatcggtcttcagtttcttaaatttatggttttttttttttaatttttgatgtctaatccagatttgcagtcctgcttgggttttcaatgtttttgtttctgtgccttcaattctcaccccagggtcaagttttattgctagatgtcattacaagtttatctcacattttttgccatctttcttgatattgttttctttaaagtcagtaaacaattccatttgtttttcatccttttattttctaaatgatctccagtatttggattgaaccatgttgtatctagagatagagtaaatcatttttcggtatcttgtttatgatgagattatgtaaaattgcttaatgtcatgtctaatatgttatttagttaagtagatatggctatagaatctatctgttagaaacagttttgcagctataactcggtcataggcatttaaatgtatgccttaaattggatttttgtatatcataaataagctttttttctgttgaagctcaaattttttttaacccactggaaattggtagaaaataaattaggctttgcttctacctatattcttatgagtagatagtggacaatgaaggcagtttccacgttgaaaactgtacaaaaatttgaaaatgtaaagtccacagtaatataaatgtattacatatgacaaattccctttaattccattaaatatgacaaaaaacaagacatgtcctatgtatcagccatgatttgttagctaacggaacggtagtaatgttctaatttctgtcttagcgtgcaaaaatgcaaacagaaaacctttttctgtgactttaaactctttaaccatcttttatatgcatctaaatacagtgagtagattacattgtagtatcaataatctcttagctccaaatactttttagagatctcatttttaaaaaccacattgttttaagaccacattgtcacattgtcttaatatctttgttcatcttcccatttgtgaaagatagtaaaaccgaagtaacaatttgaggatttttaatagcttcatgtactctgtgttcttgttttaaatatttcacaaatacctatcctaggagttgttccacttaacaaacttaattttttccagcttttataaaaatgtaatctctagtgtttctgcaatttcctggttattttactttttttactaaccaaaaaaagtgttctatatagaaccaaattcagtcttaacttcagtattactaacaaattttaaaaccatagccatctttaatctcccagtaccccactgtaggaagaatttgactttggaatattgtctcatttttcaaaggagcctgagaagtagttttggaaaatacctttttcttgggtgaactctagatgtaaccactgaaaatatctgaaatgaaacattctatcagcaagtggcataaacatcgaaaatgctgccttgtcacacataacagttctaacaagggctccttatgtcatgggaatcctactacctctgtttctcttcatatgagagcaagcagcagcactgaatttgtaagactatttggttgtggtttcctagaaggatttgtataaatgtcaggggttatttaatgctgaaagtcctgttaaatccattaagaattgtatgtacattcaattccccaaagaaatgattcattcaacaaacatttattgcaacctcttacttgttaggcactgggctcagtaatgtggagaatacaaagttaggaaagatgtggttcttgcctgaccttttagtaagaggttacttgtgttatatgccataagccagatacaaactaacagctacaacagtccaagggcacaggtagggactgggattatattcagcagtggtggttgaagatggagtcatggcagagacactgtttgaggtgttctttgaagaaggaataggaaggtattccaggcagaggggataacctgagcaaagatagagggggaaaactgtgatatgtttggggagttgaatgttaagtcagaatggctgaagcatgagaaatgacaccatcagcttgtgcaaaaaaaatgacagaaaaaaagagactggcaagaggaagtacctcttagaaagttgttgaagtattgaaggtatgaaatattaaggttttgatttagatggtggtggtgggaagggaaaactagcgatggaattgagatgcagatgaagccaacatggttaagtagaaagcagtggatatttccctccagcctactgaccttgtgctcatcttaacatcagatttctttgaagttgcagtgaaagtctgccatactttttgttttgttttgcattagatgctatcttgtccaccaacatatcttttgtgcctagtacacgttagggcttggaaaaatatttgttgaatgaaacatgagattgttgaaacactttgaaagagggagaataaatatgggctcaactgagaggtacacagagatctcttcatctgcagctgtactttcactcccagttcagtttttactcaaatatagatgaaaattgtatacacccatgtgccaactttcctcactcaaccacattttaacctagatttgatggcctgcaaattgctgatatttgcaaatttaattccatcccttagcattatagaaatgatatttggctaaatgctgttggatattctccaactgttacattttcagtgcttttacgttatatacggatttttttaaaaaattacttagtggccattgttaagtgttatttttaagataattagtgtgattatgtagtaatggtctagcattttttgtcttaaaatgtttgaagttgaattttacagcagatgggtagcttgcaaatcaaggtattcttggaagcataatgagtgctaataaggtgattctaatcaagtacaagctcataatcttcaaaaagggattttgtggaaaaaggtgactgcctagttcaaaaatatatatatttaaagtttaataaagaactcttgttctaaatacacaatgacattttgaaagtccaaaaagtttgaacatagaaagacaaagaaatataataatagagagggtccatgaattgacactttttaaaaaacccacaataactgtaatttagtccaagcaatatgcttttaaaagaaataggaaaaataataggaaagtaatttcaatatcgaagtttaagaaaggatctctaggcttatgtactatatcttggagtttgtacagtcagcccagtctcttagactttctccatgttcatctccattcctggataatgattgctggttttctgtacaggcgatcctgaggtcttggtgcaatcctcaataaccaagatatgattcaggtttggacaattgactctgctttcaaaaacagggaaggtgtctggaacatttgagaaaagtgtttcaacaacaacaacaacaaaaccttaaaatgatttttaaatatttagcagcattcagctggtgtcaacatttggcaatgatttccataattgtgactagcatattttaataggcaactgacagataaaacagaaccaagactgtctccccctttttcccaattcttgaggcctcactttagtggcatgtgacatttacttcatctttgaaatgataaaacatttaaatatgtttcacttatttctccccaaattttcctattgtcccactaaagaaatacctttaaaaagtgacattgcttccaagtcagagatttaaaaaaaaaaaaacagaaggaaagaaggaaggaggaaaggagggagagagggagtgggtgaagaaagaaagaagttaagagacacccattgagaaaggcttttcattctgaaatacttcagctccaataataatgtatttgtaacaaaaacataaggaaagtgtaatgaatagagtaacatactcatgaaaagagggtaatatagaagagtgggattcctccacccccaagagagaattgtttgtgccatttttatcgcatatttttcattataaactcctctgctttcgttgaagcaaaaatgaatagctgtgattaattatggcccagagaagtctcattctccccatggaacttgctcttcctcattttcaacagcaccactaaacatgcaccactagttacctttgatctccccactgttcacaacctccaagcaggcgtcaagtcctaggtcccccaccagcacaactactcatgcctctagttatgggagagagaagatttgtaaactccttgtgggcagtttccatggcataatcttcatttcttccatagtatctagcacagtttttacttttatgcaggagaggtattaaacagtatgccttcttttatcaggctacaggagcaaatgcaattcagtacattttcctatttagtgttgccagaaaactcacagctaccttttgggcccagctgcagcaattaaccttagtctagaattttgaagtttttgatacaattatctccattgttccacctttcccattatatcagtctttacagttactgtaataatcttacttcaaaaatatctttcttgaaggtcattttgaagccttttgggaagaatgtaattgtctaagtagtaagagagcaagtcaacaagagaaggggctaattccatttctgcatttattatttgcagcttataaggctatctgagtgattttcatttggacatgttaatgtattccaggcattccagtatggttaactgggggcctcagtttaaaatgggcttccagtgatactcagaagtaaaccagatgcagctggggctactcgtaaaacagaaaggaataaataacaaatacttgaaactccttagacgtttactttttttcattaggaaaaaaggagaaagggttgtatgagatgtgttttttccttacttcctcgctgcagggtgcaactgatgaacttgtattcagtgcttattttgaggtttagtaatctattgatacttcggcttttgatcatctgtgctgaaatgctgtggtcagcattaaattgtttgcctaatcgatctggaaagtattttcctccttttagcttgtctttttctaggtatgttttttttaggggtgaggagaaggggtaatgttctcaaatgattgggatttctgtagtgagtaaaggtgtgagtttattggagagctgaggggcagtttttaaagaatcctttattcgttcaaatttgggtacacagaaaacatttagaaaacactctggaaatgtttatacagcaaatgtaagcaacatacaatacagagctctcatatacatacttaccatcataactaatagccctactttgtaaacagaaaatgaatgtgtttcctaggagtagtagaatagattttgagaaggccaatccttcttcatgacctagaccggccttcttttacgtggctgctaacatcattactgatgtcagagatgtagaattaaggtgtccaaatttctttagtatgaccttttggaaactgaattatcagtaccataataaaatgcatagcaaataactaaatccattgtcggataggacaatattcccttagagcaggggttctcaaaaatgtggcagactagcaacatcaacttcacctggacacatttagaaatgtaaattatcacctcacccacacctactgaatcagaaactctgtggggaggcctggcactttgtgtttcaagaaactctcccggtaattctggcaaacactgaagtttgggaaccattagtttagagaaaaccataattggtttagcagggtgtcaattaaggatgatgtttcaaagcttcataattctcaggattctgtgttgttcctctaatgcctcctccttcctcaccacttgttcaaacggccctttcttgatatatattcagatctgttggaagggaaatgatgtctattctggaagacttaatgtttctttgggagacctattatattttccctccaaggagcatcacaatgctttttagctgagaaaaggctctgagaggtattgcatgaaagacagtttagttctgttaactgcgtgttagtgtagtttagttctgttgaacccaagaatttctgtaaatcctttgatcacagaaccctatctttgtggagcatagagaaacttatggaatgctacataacaggtgactgggcaagaatcatgctggtgtctaaatgtgtggaacccaaaagaaatgaagttattttaattatttgactattataaccctttgaaaggattagtgacttttttgtaccctgaaaggcgtattgtaggtgttgctagctgccacacatggaccttcaaattttcatatgtagcaactgtgagaacaaaagggtgtgtatatgtacacacacacacacacacacacacacacatagtatattcagacatttcacatttatatgagtcaatcttcacttccataaggttagcctattaaaatgaaaaataagaaaaatgaaaaattagctcaaacatttataaacagttttctaatgagattcaattttattattttaccaatttatttaaatgatatttaaaatcacttcgctacaatttttttttaatattttaagcaccattaacatcttttatagtctcttatttggctttgtctttctaacttaccaggaaaaaatgacttgcctgctttcttgttatcattttaatatatgttataagtaaaatataacagtacccatggcaaaattagaataaaaatagtaccaactagagtgtgatgctccatgcttttttatataatacaaatgactttgaatgtttcattcattatgattttaaagtggatgttcgttatgctaaatcttaaagaagcttgtgatggtaaaagagtgtctcttgactaggtaaactagtctcctaagtgggcactggcttattaccacttgaaaagaagcaataattattttctccttttagttatttacgaggatgagattaaagcttggatatgcttcctttatcctctgccttttcgcctagaatactactaagttgtgggaacagcgactgtttgacaataatatccagttctaataagagaagtgtcctcagtttcctaacattatacgtatataaattctctccctaggcacatagtaatttatattactcatataattggtaattactctatgataatatattacctcttttagggaagtagaatgatttaaagtagttataatctgtcaaagttattatacttaattctcgggaaatattttagttctgttgtaaagaactaataaagaaaaatatattttttacattttgtactgattttacttgcaaaacagactaaattttactttgttccttttttctttcaaagcacctagaaagtatgtaggggcaggaattatttctagagaagttaacacgattggagaataatttaccgatgatctaaaactaaatagaattaagggcacttgaatctcagcttagcactctttctaataaaatactgtgttcctattgaaacttaaattcatttcttcttgggaacaaatacattagaggacagagtatgaacagcctgtgacctgcttccgaaacagttgattcatataacagtgttgttgttattattttccctattatattgtctttagaactattagtatacttttggattctgcatcttcagttgtctagtcactttttattttttctgagacagggtctcactctgttgtccaggctggagtgcactggcaagatcatggtgagagacaggactagctggatttcctaggccgacgagtaatccctaagcctagctgggaaagtgaccgcatccacctttaaacacggggcttgcaacttagctcacacccgatcaatcaggtagtaaagagagctcactaaaatgctaattaggcaaaaacaggaggttaaaaaaaatagccaatcatctatcgcctgagagcacagagggagggacaatgatggggatataaacccaggcattccagctggcaatggcaaccccctttgggtcccctcccattttatgggagctctgttttcactctattaaatcttgctactgcacactcttctggtccatgtttgttacggcctgagctgagctttcactcgccatccaccactgctgtttgccgccgtcgcagacccgccgctgacttccacccctccagatccggcagggtgtctgctgcgctcctgatccagcgaggcacccattgccgctcccgatcgggctaaaggcttgccattgttcctgcatggctagtgcccggattcgtcctaatcgagctgaacactagttgctgggttccacggttctcttctgtgacccatggcttctgttagaactgtaagactcactgcatggcccaagattccattccttggaatccatgaggccaagaaccccaggtcagagaacaagaggcttgccaccatcttggaagtggccggccaccatcttaggagctctaagaacaaggacccccagtaacaatggctcactgcagcctcagcctcccgggctcaggtgatcttctcattttaaaaagctggggagaaacctaatgataaatcacagaatagaattgttgtgtttattttattggcatgtttacatgatgcagccacatattaatttgtatttgaaaccctttagttttattttgtgaataatgtttgcttaaccaaaaataaattgccaataaagaaaagaaaagaaagaaacatgacttgtacatttgaagcactgaaaaagtcaaaccctagtgcctagggccgcagatcttcacctccactttgcagtatctcaaaatatatctactttacggtcatttaactaaaacctcctctgaaactgagctttcggtggggtagtcttttgtgaaatggtgtgtgcagttcatgtgcgttctcatttgcctttgtccttaggggaatgaaatgcttcagaagaacactttgtaccattttgtgttaaggttgatcttttctcatcatttggagactttctctgctttgtgatagtgtcgaacctacagcactcaacttgtcatctgagtaaacttgcttctgaatggcactatggtgtttttaaaagattcttctcttagggaggtgatgatagtcatgaagttcacagaccacctcttttgttgagtcctacttctatcggttctcaatctccatgggatactgctggactgttacttttgtcaagtcatggccgtttatgcttaagccctcatgacccaactcctgataattggacattgcttctcccaaaccaactagcgaaatgctactgtgcaaacatttactaaaaagctgtgttaacagataacatgtttatgctaattgttctgcttcaggaattatggaaggctatttctaacatttggttacctagggccaggtacagtggccctcacctataatccctagcactttgggaggctgaggcaggtggatcgcttgagcccaggagttctagaccatcctgtgcaacacggggaaaccccatcgttacaaaaaatacaaaaattagctgggcatggtggtgtgcacctgtagtcccagctactcgggacgctgaggtgggaggattacctcagcctggggaagttgaggttacaatgagctgtgatggtgccactgcactccagcctgggcaacagagtgagactctatcttaaaaaacaaaacaaaaccaaacaaacaaacaaaaacaaacacattcaattgccttgacacattcaattgccttgtcttattcattctcaagccatccaaaatccctgggttttgaacaaaataaatttgccataaaattgtgctagtaactagtgtctggacatacctaacagccagttgatatgcagtctttgttataatcttagagggaaagtgtggcccagacagtataaatatttgaaccagctcattcctctatttagaactatcacagtattatgaagcacagtatcttgattgagtatgagctctggacacagagcacgtaggttcaaatcccagctctgctacttattagttatgtcagcttgggcatgcgtcttcacttctcagtgcccccgtttcctcaattgtgaagattaaatgagttaatgcatataaagcactttgaacaatgcctggcacgtggtaaatccacaacaaagttagccattaatattaaggtggacatggtgtgaaaaaatggaaaccagtttacagtattctaaaaaatctctcaaattagttttgtttctatgactagttttgtttttaaaattagtttatgttttatgactactttcatgatattaatagaaaatataattttacaggggcctcaacctggtgtctaaatgtgtatcaacaattgtctcatgccaagtaacatgagctaaagctgtatatacaatatctgcagcttattcataagtgatctgaattagttaacatgaaaaggatcatttgaccttatatgcaagagtctagtataccaagtcaatgcaatacatgaaacaatgtaaaaccaaattaatagtctagttatctttagtagaaaaatgagtgtaaaagattagcacactgatgttttacactacctagtttctttcgctctatccactttgtcaaaatctttgagaatggaatttgatttaccttatataacagacataaactgacttatttttttttcagaaagatgttttctgaagttttctaattttatcttgattttgagggaaagcacaatggagctagagtagatttattttatttatttttcttcaccaaaataaggattccgctaattaaaaggcactgactagaatatcaccatggcctgaatgaccccagaaatcttttcgtgcttaatagaaaggatgcacatttttaatgaacactacatccttagacatgtactgctcttctaataagtcttgttccagctgtttaaattgactaagggagtacagttcatagattttgaagctaactaattaactctctgttctttgctttatttttttcttgttttgggtgtggagatatgcatcctttggcagtggtcatatttcaacttcttctctgtaaggccatgagacatttatggttgaggcattgatttattttaaagcaaaaagcctccctttatcactattttctttaaccccatttctagttacattgtttgtggagggccttgtttagttctttaaatattgggaacagtttcatcatcattaaatattaactgctcactggaagcagaagctgagcttaattaaggttgcagtatttactaaattagactgggagaggaacattttaagacacacacatatatgaaagagagagagagagaaagaaaaataaatattttacagtaatctcagcagtttcattagagctttgtcaattgtgttcgcatatctgaaacatttcatcccaaaatgaaagttacattttggatgaaacttaacatacttggtagatattcaggccaggcagaatagatctttatttttagaagagaaagcatttgtatcaataccttgttttcatgtctgtagaacaaaaacaaacagtaagttggcctaattttcagatgctttttaaaagaatcacttggctaaaaatgccacttaaatacacgatacatttagagtttggaattttccctgggcatatgcctgatactctaaattacatacaattatattttatttgtaattgataattattatgggaacataacagttgtgcatatttgtgggatacatgtgatattttgatacaggcatacaatgtgtaatgatcaaatcagggtaattgggatatctatcacctcaaacctttatcatttcttcgtgttaggaacattccaatcctactcttttagttattttaaaatatacaataaattgttattaactatagtcaccctattgtgctactgaatactagaccttattccttctacgtaattgtattttgtacccattaaccatcccctctttataaaccccttctcactaccctttctagcctctggcaatgatcattccactctctatctccatgagttgagtgggttttttgttttgttttgttttgttttgttttgttttagctctcgcatattagtgagaaacgtgcagtattgatctttctgtgcctggcgtatttcacttaacataatgttctccacttccaatcatgctgttgcaaatgacagaattttgttcttctttatggttgaataatattcaattgtgtatatgtaccacatgttctttatccattcttccattgatggaaacttaaattgattccatatctcggccattgtgaataatgctgtaataaacacaggggtgcatctctttgaaatactgttttcctttaggatagatacccagcagtgggattgctggatcatatcatagttctatttttagttttttggagaacctccatactgttttttttttatatatatagtggctgtgctaatttacattcttaccaacagttgcctactttcctacaattttaataacaagttagcacaaaggtttcaatagaacttttggtgatgaaatgtatattttccctaacaaaatataaacttagtccatgcctcaaaagtattttaatggcagtccatgtcaccaagtaaaaactttctgcatggaaattccatttttggtgttaggttggtagtagggtaggagtgtgaggaaaatgcttattctgaagtggagacatttgacctcattgggggattgaaacataatttcacactgattaattcaccctgtaaacaatcattttggtacaatgttttacatttctttatctgaaagaagattcatgtttaacaaaagaggaactgattttcatctttgtaccgctaatttcaaaatgcagaggtaaatcaatagccatatctaccctttatataaagtttgagtggagagatatgtggctggttataaagacataattatttaatttattctgagcagcacactgagccctgcaaagataaattgtttaaatctgaacaataatcagtgcctttctcaccttatactcttcatatacatttgtaagatatttttgcaaattaaattcttctttgaaacttttcattttacttagagacaggaaatttaattttaccaagtggaaaccccaaggtttaaggttagtgcaaaactaaaaccatttggaattgaggagattgcccaataccttctgacttcccaggtttcagtacagcgaaaactcacttgagacccttaagtcatggaaagcctaaaataattagcatggtttcaaggggcagaagtcacaatgtaggaaagccagttaggcagagaaggcttgacgttcttatttcagaagttccttgactaaagccttcaaatgaaagaagaaagccacggcaaccatttggaaagatctgacgaaacttacagctttgaaaaggggtgttgggaaggtgattgtgggatgttactttgcaatcataggaaaatatccatcttgttagcttttgggagatcagggatgggcaaaaatggcatttcaacagaagagccatttttggggagttcactctatttttctatttaagagaaatcaaaatgaaaatactaaggaaaacttgacctgtaaaacaccatacaacttggttgaagctttagtttctttacctatagaatgaggaagttggattagatcagtattttcctaagggtgtactaaagagagatgttaacgggaatatgatgaaaaaaggggggatggtttgtgagttaaacaatgttgggaaatgctgggttaacaaaggtaaccaggtttctttactttaggacatgtgagagcctttatcatactcttgtgtattgtcagcctacaagagaggaatataaagtgacatttcttatacccgattgaccagtgaacccagcttttgaggttcctctcttgggattagttgtctgtggtacacactctggcaaatgctggactaaatgatctctaagagcctttccagctttactatttgatctttctatgatatgcccataaacatataaacttccccagagcagtacaattttactatttctgaccttactaattcttaatctttgatcattccaatgaaagagtctgcattcttaatgaaaaaataaatttaggactgtgtctagcaattgcttaaatgttcacaattgtaatgtgaggctattgtggattgccatttttctcgaatatattatttggttcattagaattagccatacctctctactttgtgctctcttttaatgtgagtaatcagggattgactgaaaaagatatctatgcaaataatggctattcatctgcatgctgtgaatctgtacctttatagcgcttatgtgtgcatatagaaacatgtgctaagtagttatttccctgcactttaatgattgacttttactcgaatttgagtattccaaagacagggctgaaggaaaaaaagaaaagattaaccacccctcacctctgcacacataaataaaaaccttaaaaaacttaaaagcctcatctttatgtaacacctcatatactcaaaaatctgttctgtaaattcggagttacgggtttaggcaggtattggtcacacaccatccccctcttcatcctagcctaaagggggagctccagcagacatcgagggtatttaaatatactgttgcgccaccggtgggtgggaaggtggagtggctgccagggtagcgagccgtgtgaagcttttggtgggaggagctatggatcaaaaattgctgtctccaacagtcaacttccttaaatttccttgcagctgatcaggtaagctggggctgagagtgtcttctactttactctgggcaaatgaaggcctgggagagcctgggctgattccatggagagggcttctaagaatcttaaggtaaagaggtaaaatgggttttcaaggatttgcctttattgagctcaacttatcaaggcagaagaacagagcgggagagggctgccagataacatattgtatggggcatacttatactaaaaaattttttttcactgtttatctgaaattcaaatttacctgggagtcctgcatatttatttgataaacctggcatctctagagaggatcctaagcagaagccctagctggggaataaagggggcaagcagctggtaccctctttgtcctggcttctaaatcgttgtggcaagtgagtggatggggtgtccagaaaaaggaggtaaagaagcctaggagcaggagatttgactaatgggtcagagagaaacacctccttatgttctttcttaatgaagtccatgtagaaggagctttttgaagttatatgattttctgtgtgttttatttcttagagtaacaaattcagtaccattactttttctctccctttttttccattcttgatgacattttatgttggcagctatcagctgctctaaagacagcgtctagtaatactttgcatgaggaatgccttctgacttttgataacttggtaccaatgtgcttcgttgtgtttgggttttaattttattctggttggctggtttgtaaatagatgatgcatttttgaagagcttataattgaccagtcattcagttaatatttttctacagtgatgtacggtattcgatgagaaccgaggtaaaaagtgtgtaagtggggtggaatagggcaggaagtagatttgggttattagtgaggcaggcttgctttcactgtgaacaacttctgggatttttagtgttatttgctgttcaaaaaatttctaagaaaaagatcaagctcatgatcatttgaaaataaatgtttaacgtaaacaaagctaagcgtgggtcatgaaggaaagccgcaaacatttttcttgtaagaaggcatatgcattagagagccacaagaaggccccacctgctgtgattttcctaaagccacctttgtcttagtagcttcagggaatttgacttgcggcttgttcagagaaattcaggatggggggtggggcagttggagaacgcagtttttttctaaactgaccctggaaatgcagggccctcctgggcaggcccaggtgctgattagatatggatctgctgctggctcctttattcgtccggtggggccctatatcctgagggcctttgtggccagagaccccttggaatcagaccagagtttctgtctctgggtctcatggattcatgtcacttctggttaagttatactaaattaccaggatgtttcagccgtaatggtcacatattcctcagggtctatattcataggaaaaaaaaaagttaggaactagctattttctggacctgaatagaataacggttcatttggaacagacaaccaggggcagcctcagtcatgtgttgactattgttctcttcttggagggagaagaaagaacttatgaaagaaaatagcaagagaagcacttaggtttctaaggtagacttagtgttatgccctataaaattattctcacaaacttcaacaaacgtgtatggcagggcggctattcatcaggcacacacacatccctggagattgaaagtggaggaagatgtagttctgccgttatacaggctcaaagtctaatagaggagacaagcatgcaaacaatttatcgatgtacacagcgataagagctacgataaaactgagtacaaggtgcagttggaagcacaaaggagggagagataaatggggacaggaatggggagacggttccaggaaaatctttacagaggaaaagtgatttgaactgagaatccatattgggtagtgaaagtctggaaacttggcttgtgtgcttactgagctgcttatgaattaggacaagtcaccccacccctttggccttcacattctctgtaagataaaggtgcacaagatgttccctacaatccgattcagccctaaactgtttccatcctgggaatcaagttatcttagtgggctatttcagaacaaaagtgtgattgttgagcccagtactccctttgtcattgggagatcaaaatgtaaaagttctctggagacagataggcaagaaaattcttctgctctcaccccagcttctcgcctattcaaacttgttatctggtttgcgccaaagtcattgccctgtgtatgtgtgtatgggatgtgtcaagaaaacagagttgggacagcatgaagaaggtgggtacagtgctggctgcaatggtggggggtacttggctggccctctccatgggggtcaacgttcagcctcattaattttgccttcattatatttaagaaatggtttattaaagacttttccctctaaatttcttgcctgcatctcacatttaacttaaaagttgtatgcagaattttaaggctgctctttgtgcatctatatcaatatttatagatgatacaatatttggaggagaaaatgatgcagattatccatttttgtaaagacagaattctaagaggaagaaagtgggaaatttgccagtagaatgccgatatctggctaataactcgttgtatgttgatcttgactcaggtttttcctagctttaataaatctgtgatgcttgcaggaactagccaaactggtacatatgatttgtaattctgaaatcactgttacttcctctgagaagccatgtctgtgcatgtaagtatgttacagtggggcactatcatcagaattatttcatttaatccattatgattaaaatggaataacaacatttttcttcatagaacaaatcatctcttgggtgccttgatttaacatttaacttttaactgttggcagtctagcagatcagtgagattatgtatttgaaaagtaatccagttataattgtatttgagagaacatatttaggattttttttttctctctaactctgtatgtatttgaagaagcaagtcattctgcaaacagctgtttctcttaagatactgtggctgacaaagggtaatttgcagcctcccaggttccttttcttattctgatgtatggtagggctttttctcatgaacatgaagtacatttcacagggtttttctaccacccagtgcatgggaagtcttgtgacagactctgactctcataactctctagacataggtgggatttgaatctctacaatgagacttttctctcttagttaaaggctttgtattcatttgggagaagcctgaaggtaggaagaaggcaatagattgaatttgggaggctttataaatgttctgcaatgtatccctttgtctgtcatcaacttcttgatgcagatgtacttcagaaatgtcatcggctattttctccccctgcttgctgctttttgagtgcatttttcaaagacagtcgatgggaaaggggagctggaagattcatatgattcataggtgtagtagcacttatttcagcagagaatcgctttcctattgaatcactttgctattttcttaactcagtaacacagtgaaagaccagatgagaatgacatgttttttaagtccaaaaggaaatggaaaaggagggaaattgaggcaagcataaatgagcttgcactctaatcgcttcaacgtttctttaattttgagtgtatatgggagggggagagagagagagttgattttcatgtcttgactccccttagctgctgattttagtacgtagcctgctctgccagaggatggcgactgttgtaggtacgtttacagagtcgtttaaggcatgctctgatactttgcactagtgtgagccaactctgaacctgtgggtctagattggaagaaggagggcttgggacaccattgacttggctagggaaacatgaagggtgatttttcagagccaagatggctgctgggctatcacaccaaactgttatagacccaatgtgatagggtaccttgtggcccactcagagtgcttaggtggcctacagaaatcattggaaccttcctagtacagagtcattgattttccaaaggacaaaaacaatagatgattacctactccactgggacagtccctccctaatccccactctatcccaaccttacatgctttaccaaagccttaattctatacaaggattaaaaaacaagtgttaacagatgtaaaaaaaacaagtttgttctctcccaaacaccaattaaagtattttggcctataattacgtttgggcctcttgaagaatgaacgctatgtagaggagatttattatcaccaagtgttgtgtgtacaaatatattatcctgagttctaaagtcgttttgaaaaaacaggggcatagttttcttttgaaatgttgtattgcacggataatatagatgttaaattacttggtctcctcatctattgtttggatagagaatacagatttttattttattttataagctttctggaacataagcagcagtctctggtaagatggtgttgctatgcatttgcattgttatagaattaaattatggattcggtcattcaaaatagaagctttataaatcaagtaaaatctcataactaagatgaataagtttctttaagtctcatgctgcctcatattccatactttagttttatagcccaacttgatataattttttaaagtgtaattctctttttttctatttctgtgtactgtttttgctctgctaaactgtcattatttcccaagaaaaagcttaagataagttactttatgtaaaggatagtgatataaaagcacaaaggcatgttcacttctttatctgtatattggcaggaaatgtgccaaatacagtgtgttctctccctccctttcttcttctctctctgattacattcaatgtagatgatattaaaactcaattgtaacaaatggtgaaattccaattattcttttttctttttttaacttatctaatgtctggaattcctgaatatgaaagacagtcttcattatatagttgttttggagttaaaaattgtgttccacgcttgtgtatgctaattgtctaaacaagctatctaggtggctctgcaatccttaagcaatgctgctgagctgcataatttattttccccactactgctgtctaactaccccaaagcataggaattagagtggtggccctaactgggagtatgcagtaagatgaaaaatagtcaaatgagaaggaaggtcagtaataagttatttagacctggttaggcagcagggtctccaaatgcagctgcaattggtaaaaaaaaaaaaaaaaaaaaaaaaaaaaaaaaaaaaaaaaaaaaaaaaaaaaagactgaaattcagaagagaggtcaggggtagagatagagatttaagatccgagcaattgtacaaatagatggaactttgaaacaacttagtctctccagggaaaagagattagagaggagagcaagaggatttagaacagggccttggggaaatctttaatgttagggtgtgggaggaggaagagaaaccctgaagtagaagtataaactagcatgcttggctgtggaagtcaccaagtgccactccctccatcagctgttaattctgagccagatcacctcagttatgtagatggagagtggagaatctaggaactgaagatccttgtgactttctgccttgcttcacattggtgggtgtaaaaagaagcttatggtctctcttaggggtacatttatggggaaaagaccccaattattgtgatttagcacacacaggggtctgcttacactcattatatatgttgaaattgcgtagctattcctaggctacttttaagaatttaggaggattaggttaacgtgattcttaactcatactaccaataaattattctttctccaaggtttgcatagaaatataaaagtacataaaactaagatagtatttgattttgtaaatcactttaatttaattaaatgtaaattgagcaatgggaaaaacaaaaagacaaactcgacagaaaacaatgatgtgtcttttaatttctcacactgactttaaagttatactcagcttcttgccagaggaggtaaaacaatagagccaccttgccctagtgatctaatatttaaaaagagccgttgcaatgcatctgggtttgcattatatgtagctctagaaaagttttgaaggacacatcttgattctcagtgaaattataggaatattttaataacaacataactaaacaatggagaagccattgcataaactgtgtaggcatcataaataaggaaaatgcagatagcatgtgttgaatgaaaacacttggtgaacaaactcatttttctctcgggaattcaggtggcctagcagcttgcactctttggtccaaaaacaaagttgcccttttgctccccaccttccccttccccaataacctcacctactgtaaagaatcttagcatctgtggaaaatagaattgtttgcagttgtgctttcttaaaaggtttatggtggacctagtaatccaaataagagagaatcgttagcttctttatatactgctcatgagttcaacacagtaataggtcacattgtgacaatgtgaccaacaactagtccagtgacatcctttgctgctacatagtaaaccataatcagcagccatgccaacatttaggtgacaccaaaagcatgtttgattccacggaactgacatactgtcctgtcttgaaagtgcttaacatcaataaaaaacattcaattagctgaggatccaaaatacactttggtttccatcatgcaagtgatctagggccattgtctccggaacctaaagaacaaaatggctgccgggcatagggatttattatttcattaacagactgtcagtgaatttcagggtgtttctcgccttatatggattcaagatgaagagttttggagcttagattgtccccagataatggagtccaaaatttatctatttgtgtatagttttaatttaatattttccctattcttcattgtcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttgtaagtcgcagctatattttgaaaattgccgataaagatcaacagtggaataacctggcagggacttggggaaattagttgcaacaggatttaggacacaaactaatatgttcattgacactacagagctgtgcacttgaagagagcagtcaggtgtgttgcactgaaaacctggctgcatgagttcactttataaaagaatatggataaaggagcaggggcattttaagataaggagagttgattattattacatggaaacctttgaattctaggacattaattcaaacaaattttcttgttctttgatgggggttttgttgctttttttttttttttttttttttggtgagacagagtttcactcttgttgcccaggctggagtgcaatggtgcgatctaggctcattgcaacttctgcctcccgagttcaagcaattctcctgcctcagcctcccaagtagctggtattacaggtgcccgccatcacgcccagctaatttttttgtgtatttttagtagacatggagtttcaccatgtccaggctggtctcaaacgcctgacttcaggtgatccacctgtctcggcctcccaaagtgctggaattacaggcgtgagcccggcctgttgttgcttttaaataaacgttttattttgaaataattttagatttacagaaaagttacaaaggtattaatagtacaaagagttcctgtattacctttcacccagttctccccactgttaacatcttatattaccctggtagatttgtcaaaagcaagaaactggaatcacacatcattattattaactaaactccagactttattcagatttccccaggttttctattaatgtaatctttctattccagtgtctgattcagggtaccacagtgcattcatttgaattttgcctcccctctcttctctgctctgtgaccatttctcagtttttcccaatttcccatgatcttgatagtggctttcccttaacttagctacagggtttccctatgcagaaattagtaagattatgtcattctagactaatatctactattttctggacttgcaagtttaaatggatcctttataaagtaattaagctatatctgttcatattgttctattgaaaattcatcttgccctatgccttaaaatataaactttcattttgcttttacacctcttagggagaattgaaaactgtcccttttctgctgtagttcttcaggcctcacatttagctcagtggtgcctcattctaattccagctggcctacttcctttaaactattaacaggataaatttgaaaatcctgttttacctttatttgttacccatttaatcagtgatacaatgaacatattgaaagttgaaatatgtatatagtatttagatgcaatgaaaatgggggaggacaatcagctgtcagtaaagcctatctcattataaagttaattctcagaattcaaggatatctgtgttgatatggaaccctttaatgagtacatctttatggataaatgcaaaaacagatgggagaggcaatgatgaatcactaaaggtttgcaccatactctttttccagaatgtctagacagatttaagtaaaataaatagatgtcatgttctgtactattagtttaccaaaaagttttgccttggaactcagattaattatgttggtaaattagttcctagaaggtgaactcctcaaagctcctctttgaccctcagtaattctttacatcgttgaactccttgcgcaaacgctttttctgggctttcacatactgacgtatctcagtccctccctacttctaagggcagagggaagataaagtcttttggatactgaaaattgttatgaacaaaaccacagagaagtgatcgtgcttggtaagtccagaaaatgtgagtgggtggggaataaagcaaggcagcttctattttttcccccagctttattgaggtataattaataaataaaattgtgtatattttaaagtgtacagcgtgtgatgatttgttagacgtatacattgtgaaatgagatgacatggatgaacctggcaggcattatgtcaagtgaaataagccagacagagaaaaaacaaatactatatgatctcactcatatgtggaaccttgaaaaaactgaatgcatagaaacagagagtagaagggtagttgccaggggatgtgggtgggaggggatgggggaagatgttggtcaaaggtatagcaagggagattttaactcacaattattactctcagcttctcatgggatgtctcaatttcaaactgagcaaagaataggaagcagatttcattatcagacacctgagcccagtggttcctacagagctggagcatttatcttttcaaaggtcgagggatagcttcagggtactagtgaaatgccttgtttcagggaatcagagagcaagaagtggggtaaagtaggggtacagagggaagccgttctattcagcctctgctagagtctctccattccaagtctcaacccttcaagtgttattgatcgtgctggctcacactggagaatagggagtagcttttttgagaatccagtaagaaatccattgtgctttccagcctcttcacttgtgctttctaatttgattctctatgctttctatgttagaatatgtttccctatcttttcttcaatgagggtaatttcagatttcagatgacggaagatgactgctatgattcacaggagtacaatttattttatagaatgttacaagatacaaggcattacttagaagacccaagggaacaattggaaattgcttctctaccttgtagattatttaatgatagctgttatgatgcgatgagccgataaatgattaattcctgcagttattatgtgtacaaaaatctaactccgagatggttgatatgttcctcttctatggtctaaggaagccactttgtagacatggtgtaattgagctagtgtgagcaattttaagtaacatttaccagtctgatttggaaaaaaaatttctttattgtggatcctgatattattacagaagtaatatatgattttacttaatttctctggtacctactctccctcaaacaactctctatcccttttaatcacccctacccaataatctgattcttgtctctaagatagtcatacttttgtttaagaaatttccagtcctgatatttgtaaggttgcatattaagacccatttgtatgactggcttgaacttcatgtctttccacaaagaatactttgatctgtttctaggataccagaagagcacatctgcctttgcagaattgaatatggtttgcttattataagcccctagataaagggaatgtcaacctaaatgcgatggtacctagagaacagattctgttgagtgtgactgaacaatgaataaaagccacacctagtcaatttgggtggaatgcttgctggagcaggcaagtttgttcactctattaaacaggtctgaattgacatttgccagtataaaagtccatctctgaaagcttttttttggctttattaaggaagttcagcaggtgaaacaaaaggtgtgactccctagtatttttcaatgcagtttaagagagattgttcctgatgttcccagcaaaaaagtataagttgaagtatccccttgccataatcatgaggcaaatacaaccactgtagaagaatattagaaagagtaggcacagtggattaccctgaagcaaagctaatgttttaaaattttggttttacaattagaaattttagttatgaggaaagattctccctactgaatgtggtgtatgtatttataaagtgaatatgatattacaggctgttaaaatgttttatttggacattttgcatatctacacctgtccatatccaaactaaaggaaaacctgggaaattcccctagtttctctctttgaatgtggtgattcacatggaaacagatcctgacacacaggtgaacttgactcagtagagtgtattcatttgattatttatatagagattgttgattcagcacatttgaggttgcattgggatgtgccaagtcctcaggttctgttgtatgctattcatggctggcattcctgtggctaagttaccgagttccaaaccatgaaggccataaacaagtcttcctctctaggttttcctttatctcaaattgaatcatctgatagctgcctggatccctctccacctttttacatcattttcataattctgtttaccaaatatatttctcataaacaggcttatatgtttatctaacattaatatagtaaggaacgaaggtgatgtaatgcttcagaaccaagagaaaaaaaataatagaaagttcaaataggtacgaggaagggagatatactaattaatgaatattatttttagactcatgtttttaatgttgtttttttctcttttactaaagggctacaatgtattatattacttgggtttatattacttataaacttaggactagaacaattttaagtgactggagataaaattggaaaatatttatttactttttaatttttttttttttttgagacacggtatcactctgtggaccaggctggagtgcagtggcatgatcatagctcaatgtagctgcagacttgtggggtcaagtcatcatcctgccccatcctcctgagtagctgggactacaggtgcacatcaccatgcacagtaatgttttttaaaaattttttgaatagaaatagaaatgtgatctcactatgttgcccagtctggtactgatttcccagcctcaagcaatcctcctgccttgacctcccaaagtgctggcatgcctggcctactttttaatttttgtaagtcagtcattaaatgatatagtacttgaaaacaagaggacaaatattcatattagacttacagttttttagttcacataaatttagtttattgactgaaatatttatgctataaaaaagagtagttttgtcatggctcttttattaacaattattattttaaaaggtgacccagacattatgtaggtttaatagaaaagaaaattatgtccatattctaaattaccagtctcatggtcagtacagaaattataacattttaatgaaggttctgcagcaggtttttcagttcacctactcatgtaatgatgaatgatggcatttagttctttcatcttgatgtggtgacattacatgttttgtaaatgatttttgcaaaattttcaagttaggaaagacaagcattatgtaattataaggttaatatgctcttaatataattacaacagtcatgatcatgtgaacttccgcattgaggttgaccaaatcatatcacagaagtgcctggagtgctaccatgccatgatcatctggattttactacattttctgaaagattagacaaaattttacttttaggtatatcaactgaagcctactgtaatctgtttgttcaactaacattgtttttaaggtgtacttaccctgagactaacatgaggggtttagggatgctcatttgcatggtttccttccaaaaccctgagaggggtcctagcaacgtgtttaaaatgtgtttgtaaaatttgcaaaatatattcgtgtgtttcattcttaaggctccacttccccacccagtggtctaagcttcagaccccacatatcctagatttgctcctcattgcaattactggtccaaagtagagtagttattcgggccttttgctaataagactgtgtatgtcacatagcttaaagcttcttttacgttaaaacaaaataaatcccctagcagtccctttgctgctttgccccatctctgttaatagacactgtgaaatctgcttttttcaaaagttgaatgaaaatgctacacttttgcagccaaacagaggacacttgtacatgatatcttctttattttattttattattattatactttaagttttagggtacatgtgcacaatgtgcaggttagttacatatgtatacatgtgccatgctggtgtgctgcacccattaactcatcatttagcattaggtatatcttctatagtgtccagtttctttgatagtcacaaatctcaacattctccctttatcatcctttatatattcccgtgagataaattacatgtaacctcctctattttgtgtccttctcctctggggctggttagctcagttagttggagcctggtgctaatgagaccatggtggcctgtgagcttcactgttcgtggtcacagtgtaagctacagccagctaccttgagattgcttgctgttgatcacaaatgaggtgaaggctgggagtttggtgggctctgtgaatttttttttttttttttacctgcaggttggtatggctcagtaatttgtcaatgagaggagaccttatataaaaacctgtggctgccctaccacctgataattaaagtggtacccccaagcatttctaatttgccttaatatcctgtaatcatctgttaaatattcatttacacccttctttccgtggtcttctctcttgaaccactctggataccagtcacattagcaattcattaatcacctggattatacacattgtgaattactttgtgtataaaaaggtgtgaattactttgtgtattacaaagtgtataaaaaattactttttatacactttgtaataaagttacatatttttatctatagtatcactaaatcacttttttttagaactcttaattaggtaccttctagtatggatttagccactccaattttaaaaatacatacacatatgggattcatgtatgtacatatgtacatatgtatgtataaaataccctgtgcttttcatactgtttgatctagcaattcatatctttatcaaaagacagcttaggactagccatctgcctaaagtcttcctcagtggagaacaagactgaaggatttattcaatttctttgccaccatttttgaaactacttttacttctttttgcactctgatttttaaattgggttgatctatttagtaaatcaaaaattaattaatggtttaggaatccctttttattgaattcagtaagtattgagcatatactctgtgacaggtatttaaatgagtaaagggtggataaaaagatgatcaagaaacaaactctaccctctaggaattcgttatgtaacaaaagtaagatgttggatgaatattttctggtccccttaatttctgatttgtacctgattcttcatatttttgtagctttgggcctttcttttttcaacatagaattatctttctattagccatgcaaggttctgttttggtttgtgttgttttgatggtggtggtggtggtggttgtggttggtcaaacccttgataattttaaactcttagcctacctatttatctaactttcactgacatgttcataaatagtctccaggtttcctgtgggttccttgctttgctcagttcttcctatttatctcccaaaaacccacattttgtttataccctttgttaaaactagataaccacttaattctttgaactacttcaatgaggtatgattgacacacaaaagctgcacatgttcaatgtatacaaattgatgactttggagacaaacagatgctcatgatactattactacaatccatgccacaaacttgattttttaaaaaataatctttgtttcctactagaatactaaagttaattgaattgccattattattacacggtggtcaccaacaaatttttaggtcaattcctgttcacctcctcaggaacaatgtcaaagttaccctgcttataagtgtcaatcatttgctctcttcctaggtgatgtgctgatctgtgtttaggtactcctttatgattcctggcctgctgttgtatttctcctcccagcaaatatgggtagctctgaaccatgacttgtgttctcatttgtgttattctttatacctcttatactcacaatcacctattgatctttcaactaacctgcctgccttcaatggttcctcttacttggagaattctctgattaataagatcagaaaatccaggtctaggtgaggacaatggttcacttttgacccatgaactttttttttcttagctctctctagagccatggggacttattcattaacaagtacgattagtacttaaacaccactatcagcttgcatctgtttttaaagttaactctcaattattgagaaactaattaactagtctggaggttatgtgggtctcctgcagcctgcattttggccacttcagtccccacggaacattactcaaggagtgtggaaatgaccaagcaaatactgtgaaagagagattattcaattgtactctgtgtgaaagtgaagtctgatggaaactaaaattatggatttcagtgcattttgggattatctaaagatagaaatatgcatgatgaccgtaaaaagagccttccttttatattatataaatgcttgcaaatgagcaataaaatgaagatattatgacgctagtaaaatttatgagtgctatttttcttgtattaaaattgggtcaacaaattgttaccaaatgtttacccttctgtaaaagaaaatatctagtcattcaactctagacaggaactcagagatggaaggccccgattattctgttgaccttaggccaggattttgaaatattttacattcatccaacaataattgtaattgatcttggatatttttgaggtaactacaaatagatctaggctattgaggagacacaaagattgatttggcataacatttaattttcatttatttatactagcttgagaaataacctgttaagtcactgttcctaaagtgtgtgtaaactagacatttatttgaggcatagttttgcattgaattgcattgcctcagaatcctttaagagcaatctgtggtggcttttaaaatttttacctttacaggattccaactactatttccccattcttagtcacggagtagtgattgttctataaacaaatagttaaaaatcctaatcctaatattagtaactatgtaaaagaacattttagtgaataccttagtattggtttacaaagccaaacattttcaatttgtggaatcttgctacaaatactaaattcatatacatatatattcatatatattcatatatatatgaatatatatgaatatatatatgaatgtatatatgaatatatatgtatatatgtatatatgaatatatatatgaatatatatgtatatatgaatatatatatgaatatatatgtatatatgaatatatatatgaatatatatatgtatatatgaatatatatgaatatatatatgaatatatatatgtatatatgaatatatatatgaatatatatatatatgaatatatatatgaatatatatgaatatatatatgaatatatatatgaatatatatatatgaatatatatatgtgaatatatatgtgaatatatatatgtgaatatatatgaatatatatatgaatatatataggaatatatataggaatatatataggaatatatataggaatatatataggaatatataggaatatatatatgaatatatatatgaatatatatgaatatatataggaatatatataggaatatatatgaatatatataggaatatatatataggaatatatatgaatatatataggaatatatatataggaatatatatgaatatatataggaatatatatatgaatatatatgaatatatataggaatatatatatatgaatatatatgaatatatatgaatatatatttggtgctttactcctgaaagcgttggagaatttcattttttgaaatcatttagaaccaaggtcggtgaactttcttgtgaatggctaaatataaatattttaggctgtgaggttcaagatgcaaagttgagggtattatataggtacttatataacaagagaggaaacaaatatctacaattttttgtaatacagctctactaatgagcacaatgaaatttgtggatggacactggaataagagtttcctataattttcatgtttcactaaatattattctcttatttttttcaatcatttaaaactgtaaaaaacattcttagattgctggccatacaaaaacacaggcaggctgaatttggcttatgggccctagtttgcagagccttactctagaacagagattcttaaccagtaagtagttcataaccccacaccaggggtgagtgtcgtggggtccttgaacttgctgagatcacaagcaacattttttgcatacatgaatttttctgtggacagagtctgcagcctttatctgactcttggagaagtcctggactcaaaaaagattaggagccagtgttgtctagatatttcgttaatttttaggacacatttcctgagtgtctgatagttcctaagcaatctgcaagtcactgggaactcatgggaatttctactgtaggagctaatactgctagagacatggggataaatagttgtcaggtgatcttattcataaagtctgttgccaccaccattcttgctggttgacaacactcagaaagatgaaaatttacacctggttatgggagggacagccgtctcttttcaagtatttagtaaataatttaggttggaatttaaatatctgaaacatttaagtgttcagaccatttcaggctgtaaagataaatcagagtcagtatagttaaaaccttttcctttacaataaaaattaacccacagataggttcatgttagctcaactgacatcaagggctgagatatatatagagacaggattaaagttgcttattaaagctgagcttctgagcttgcaggctgcttgacttaacccatggctgttagtcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctcaaaaaagaaaagaaaaaaattacagaagtaaaaagctaccataaacagaaagcattgctttcaaatacattaggcttcaatattgttgattgatcagcatttattagtgattaataactttttaatctggaaaattcacccacctccaggtctttctttcagttcaaaaattaatagatacaataatggtcctgctcatttttgtaaaaggcaagagcaaaaagtatgcaggagaatgggctggtggcttcagtgagaaatttaccaggaaagtcagagacaacgaaaagtcaagtgaagagcactatcgtgtgcttcaaaaatggactctttctcatcagagattcttggtgatcttgagacaactatgaatcattacattgataaagtctgccttattgcggaagcatgcctgggtggctgtttccagaagatttccttctcattatataaaatcatgtcacatcagctagttcctgagcttcacatctcattccatgacaagtatcccgtattcctgtagtctattacatcataagagctagttagactgggtcagcccttggctatttgcccccagactttagagtccttctcctgactacaccatcatctttcctggcacctggcgttccctttccacttaaggctcttggcaaccatgtctttcctactcaccctcgtgagtcttgccagttttttggtgccagattctttctgcccttcctaatgtcccaatcagctaatttgataaactcatctaaggtagaatgctaatgggggagtgcttccttctaagctgaatatggtttataacagagtcttcttggaatgctgtgtgggtgacaatttcaagtctgtgtgggggtgaggcaatgagtatacattgcccttcactttatattccacaatttgtatttagacttgtttctattaatgtgacttagcaggtatgggcacagtttggcaaatgcaacagattcgggggttttttcaagtgaaaaaattttataaagcaagaaggaacacatgcaattagtaatacacaatgagacaccaccagtttcacaataactaacttgtagagtcattattagaaatatactacatttagtcatgatttattattcattcattaagcttttaaaatgtatcattgagtatatctgtcaaccagtcattcactaagtgttgggtactataggggagatgagaactatcaaaggaataaaaccacattgacaagaaaagatacccacatgtggaacaaactggaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataactaaaagagtataattagagtgtttgtgacaccaaggaatgataaatgcttgaggtgatagatactccatttaccctgatgtgattattacacacagtatgcctgtatcaaaatatctcatgtaccctataaatatagatacctactatgtacacataaaaatttaaaaaacaggacctctgatttaaaaaaataacaaaatataatggaccatactaaactcattttaggtagatattaaagcactcactttttctaatttatcactttcttcctcaactccttgctgtgttccataattgtcagtgggccaggaagacagaagcacagccagtatttggtagtacaggtggggcctgtggtaggacaggcagccttacagccaagcagtattgatggtgaagaggaaagaggaaggaaagggactgaatgcaaaggccatgcctgtgtaaggaaacaaagaagattgtccatatgtgtaatgtcattggtgacatggtttttagggaataaagaaagagttggaggaaacacatttggaacagactagcagtgagatttaatttggataattcatgactgttaaaatcatgtggcttattttatgagcttaccaataaagttagtacgtaaagagatttgttggtttaaaagcaactcctctatgggaattagtatgaggctaaaaataaatcagaagaaaacaatagtaaattttgatgtggcataagtaattttgatgtttctgaaagaatacctctttgtgtaatgacaggaagaatctttacctctaacatctttttttctcttttaaacatacagggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtatttgtgaacatatatataaatacctgtagaatagatattaaccttacacataaagcagtattctcagagcccagtgtgttgttttaaataagagaacccaaatttcttagcttatagggttgttaaacattttagtactgcaatcataccttgttataaagtgcattgattcacctgtatggtaggtcaaacaatatgttaagtgtacccagccatagactgtgcgatggcacaggaagcctctgtgggaatgttccttttacctaggctccagctttcagaaacagattactatatttgttaatgagtctctacttgctagaataatcaaagtgggaaaaaagtagacaatataactctctacgattgcagaatgtaaagctatatgaacacagaaggtaaattagtctcatagtgcctcaacttttttctccattttgagagtgatgtgctaggcagtaaataaccccgatgcctaagaaaagaaaatctgaaagaaatttcaaacagctttttgatttattgaagtccttcattcttctattgttattctttgtacattgaaataactagtctttccttacaaagtcagctccatttgcagccgcttaaatgcctagtaatgtattgtaatataatctgattgtacatataactcagttatggttcacaagttgactttggaaaaccagtgcattatggtgtgataaagactcatcttggacttaaaaaaacactaattatgcttaaggctgtgtattaactggagaattaaaactggttttcagtaatacttttttaaacatttttatttcaatgtaaggacaacctccttttggggagaatagaatttttttctgggaatagaaattctgtctgtttatatctcatagtgaatatggctttacattattctttatctttttagatttgttcacacataatatattcaatgtatatataattactgttacattcactagcaaaataaataaaagccagtcagcttccagtcatcagtgtgatgcgtgtgtatgtgcatgtgtgtgttctaaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggtaagaaaaggcctgcacttgtggcctgtttcagagtaaatgctttgtatattcctcaatttgtctaatatcctgtaaccatactcatggatggtcatgagaggaccttaatatgaacagtcaaggttataagctggaaaagaaagaacctatttattctactttatttactaagattttctaaagataattatttaaaagccttactaatgcttttaacctactgtgctctttctcccattttcagagtaagggtaaattatataatttaaacagtaagttatttttgagtgcttttatagtttcactaccctcaatatcctagagaggcagaaagttgcctctgctctgtgagccactttcatgggccctttgctactaacatccttaatgcctttcaaaaacacagcacttaaaagatagggtattaagtaggttgtaatttcctaaaggttaaggccacttttcctctctagaggcatagtatcaaggacagcagcctgcttagtctggggggaaatttctacgtggttgggagcagaggcctgactttggttttttttttttttttttttttttttgttgttgttgttgttttgttttgttttgttttgtgggggtggttgtgtgttttttgttgttgttgtttgttttgagatggagtctcactctgttgcccaggctagggtgcagtggcgtgatctcagctcactgtaacctccgcctcccaggttcaagcaattctctagccttagcctcctgagtagctgggactagaggcgtgcaccactgcttctggctaatttttgtagtttttatagaggccgggtttcaccatgttggccaggctggtcttgaacttctgatctcaggtgatcctcctgcctcaacctcccaaagtgctgggattacaggcatgagctaccgtgcgcagcccagagtcctgacttttaagttgctgtagaaagccagttttgggggaacagttagtgctgcttagtaatactgaaaggtaggaagcaggaaaaatatttgtgtaacactgcagtgtgatcactgagaaccaggaattctcgtgacttaagtttgccacagctgtccgttgttttgatgtgctgcttgctatgtctttctttttctccctggacctttccttgtgtaataaggcataacagccccagtaaaggacaaaacccacaggaaacctcatgttccctgggtgtggaaaaagcactgacatgaccctgaagcccaggagatgcactgtgagctaaatctcctcacaaacattcatagtttggactcccatgacagagactttgcctattcacaacagagagacacttattttcaaacatccctattaagaaggttttcctcataccgagttgaaatttatcttgctgcaactggaacttcacaaaagaagtcagtccctattccaagtgagagtgactctcatgtctcctgtctaagccaaatactgcaaattgctcccttttcctggtagtttatggtttcaaggacacagtaccatttttggactggctccactttttgtcagaactgaactcattacatcgtgaaggatctgagcaccaaagtagaacaaacttactttctcccttgatctgaacaacataatctgttaatgaatgttaaaaaagactttaccaaattctttttgtcttaaatgcttttgaaggggtaattataagctatgaaaatagcttcatatgcatctgtccatttctgattatttgagtgtgtttgatagaatgcataggttacaagtcagcctcaaatttccacgtagagagctaaatattatatcataggccttcaattgttacttgtgaatatcaatataaaattcccttttaagtaactgatcacagcagggtcttagcagtgagatcaagttggctcataagaatttgatagaggtaagattaaataaaggagggcttcatgaagaaattcaagctttttatatttttaaggattcatagtggacatgctttataaaagagacatttttaccttgttcatgtatatagctcaggttgagttcacagaaagcagcttgtatttaaaaaaaaaaagagagagacataaagggttgatacttagttcatccacagtctcacacctcttcggcaggtttatgagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaaaaaatgtaaagtaatgttaaacttctccaaagaatctgatccaggggcaagtttcacggagtattataagcacagtgggattttgaaagaactgtagacatgaaaggatggtttaaaaatgctaataggttttagaattaaaccttacaagaacttaacaaagcaaatggtacataccgaaatggacagcaagcctctataaataagaactgcatatattttgctaactatctacatagtacctgcgtgaggtaggtcgtgggggaggaaatattcatttgctttttccttacatgttagttaggaaatatataattataggacttgaacctgaagtctttgtataaactggattttattttatggggtgacagtgtcagactctgatctaccaacatctgttttatcacctatatgccatttatgtcctagatctgtattggagttttaacaggcagaaatctctttcctgctatatctgttgcttctgctaatctcatttttatagattcatagatgagtatccctgagatattaattataaatgattgtttactgtagtagctttctgtcatatcctgcccaaatgaggtctaaattagtgaagttgaaaacctttttttttttttgcatttttttttgttttgcactactgctcatgtagttggactacctctttttttttttttttttttcttgagacaggctcttgctctgtcactcaggctggagtgcagtggtgtggtctcagctcactgcagtcttgacgtcctgggctcaagcaatcctcctgtctcagcctcccaagtagctgggaccacaggcatgcaccaccatgcctggctactttttctattttttcagagatggggttttgccatattgcccgggctggtctcaaactcctaagctcaaacaatctgctggtctcagcctcccaaagtgctgggattacaggcgtgagccactgtacacggctgtgaacccccttatctctacatttggttaccttgctgtggggccactgcttatccagtgtcttgcccaatgcatacccttacggaggattcccaggaaataccttatatgactggtgcttgcttggtttgagtacatttgttactttctctagtactagtaccatctctccccccacaggccctgcagcctggtacactgcaactgataccaaagagatcagcactggaaaagcccaatggtgccaccccggtctttaatcccactgttttccactgccaacaggctctgactaacctgcagctcccacagccggcatttatccctgcaggtgagaacacagctctaggcactgcagcgagtttggtgatgttgtgaatgtatacaatgcaaaacagctttcaaagagcttgtataggaggactgtcgacatgtattttgattaaaaataaaacaaggaagttatgcttatctgctagtatctagaactacttgtttttctataattcatgaaaattcatggtttgaaatcaaactaggaaaaagtatcaacatttttctttttagcatttgttggtttttgcttatgattaattcacttggttcagtctcaaactaattccttgactcttaggtatcactgtcacagacagtagagtgctgtcaaataaaaaggcaaaaactcccagcttcgatattatggaaatgcgttgtcaatatgtctttgatatgccaaaggtagttaaaataaaactaccctaagtgcataatatagtataatatagattaaacagatagttttagcctgtaactcctgaatcagttaatataaaatacatagcagtttatattttctgacattttgcagcatattttgttatctcctacattcagctatatttaatagcctgttttacatgaaattgaacagaaaatgttaagccagaaatttgttcaattagatatcatatattggggggaaactaattttcttccagtggtttagtagtttaagaatgagcatatagtctcttaggaataaattgaaaattctaaccattgagagtacagcagttttttttttccatttttttttttttttgacacaatggtaaatgcccaagattggaaactatttttaaatgaaaataacatatgttttaaaaaataatttagaaatccttgttaatacccagacttgagaaaacttattggttaactagtaaattaatcagttaattaattttgaaaggtaccataaaacaccagtctttagttactagccacagcagtccttcatgccatcatttaaattatacaatttgtatacatttatatgatagtttctgagaggaaatatggaattcttcagcactttcttacatcccttataataagtaactactgatatctaataatttagatattttctcccaacctaagaaaaacacacataatgtctacagagtaaaagagaaaaccagtatgagttgacatgactttattcctagcattttttttcttcaaaaattgtggtaatttacctacacattagatcactctaccttggctacttccaatttgtattatagctgtggaatgaattcagtagccctggaagtctagtcaaggtggttgaatataataaaatgtatgctgttcatcatagtttttcttaatactacagttactttgtttccaagtttgaattttttgccagatttggccaacataaaatctagtttcataagcaaaaatgtcagaaaaattccctttcccttaattagtagcaacataaaagcctgtccagctaagaggtctctcttaatggaacctctttgccatatattcatagtcaagtcctattgactatgagacagtggaggagacagtgttaacagattaatactctaaatagaaacacggacaccagatacgagattctggagcatatttagaaaatgatatgtgtaataaattaaaattctcttattataaaaattatttaggatgtatttgtccacaataaatatgtaatttaagtgagttaattcttttaaagaaaaattatagctgattttgtacctaagaatccaagaattattttgattacctgggtttgtgaccttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaatatttgaaactagccagactgggcagttttgttctttgcttaacatgtattatttaaaaattgtaaaatacttaaaatgtataacttgtaaagtacaatgaaacaattcccacctgaaaaagttatctataggacttaaagcattcaatgttcctatgttgcgagaggatgagttcagcaaagccagaggattctgcagtgttctgtaatgaatcctgtagtgttctagcctgaagcaccattggcacagaagctaggcacaacagaatcatttcaaaatgactctttgagtgttacgtgatttttaacaagcagttgcacacagatccttttgttagccactaacacaatatgatagccatctctaaaccattttatacagcactaatactgaagagcatgagaaaggaatggggagttcacagctcctacagtcctcatgggcacaaggaacagaccaggagaaaatagctctgttctatgcaaggagaaatgatcccaacccgtcccactctaccgtctcacatcaatccaggccatcccctcccttttgagagtttgcaacaaattgacctttgtcaccttggtggaccagaatagatgcagagccccaaaagcactactaacaggcttcttgagaataaagttcaaaatgacaaccacatagtagcagcactcactaacatagcgagatctgaaccctgggaatggaagtgaggcccctgttactgagggtttgactgtcttctgtaggaattaataaacatttccattaataccaacaggagcacaatatgtatacctttgaatcataatgtgtacaattagaacagacttctgcaagtttgagaaatgtgtctttgccttcatgttttgtgacagttttcttgaagatgctctcttgtcctttcaccttcagagctttgcttaggaatgcaaactgcattctttagtggatctgcttcctgtacaattgctgcactcccaaagggaaaacaagagtgtttttagaattggcatatgagacaacagggatggctctgggtaatgggtaactagagataaatggaagggataactatggagtttctgttaatcaccatttggggtacattttcagtttctatgacattgcacatgttaatttttctctggccattcattttctctttagactttcagaaaatctgaatttaattgatgtagacatgataaattattacatatgcatgcttgccattcacacattgccattcacacattaattccctggtttgctttctgaaatgagctagacatcagaaagcacccaaaacgctttctaaatgagatagaaactagaaaaggcaaagataaaacatcctgcaagagatttcacagctgctaaccattgtagctataatagttgctgtgaagacaagatttactgtgaagtactccatgtatttgtttgataaatggccaaagtttcccaggagtttgccagaggtgtacttaaaaacctgcatgcatagtccactgtattcttcatatctgcccccctaccacataccaaccagtctacctaccatgtctttgcatgcagatcaggtaagtatacatataactgcctgtttgcacctgcaaatctagtgacggcattcatgtccataagtcagtgaacctaaattccaatttatgattccttaattccattttgaatgtgcagtccagttacttgtctgcttaactagcttcagatagatagcccttgtaacattggatttttgttttcatatgcattcattatagccccttctgaaaatttagccttttgagtaaactacaatgggattctgctcaaaaacttactaaatgttgagaatggttccattttccatattggtaactataattggctttccccttttctctttttaattttccccccttccatgctgtgttgctttgcactgactgtgattgcatgaacaccctgatgtattcatcgttatgatgtcacatggcttgttgctgtgatacctaccacacctcattccatcgtaaatgttatggttgcataaatcctctaccctcccgtgtgttgcttctatggttttcaactgaaagtgcccatgatgcacggtgctacacctaccactgtgtctgcagcaacaacacctgccaccagcgttccgttcgctgcaccaactacaggcaatcaggtttggccatttatttaagctgttcagatcaagataactacaatgttttggtaatgcacagtatatgctttttggattggtgagattcttatgtgtttcttaagccattgtcacatttagaatttttatttttgtgtatattctagaatgctatatgtgctttgctattcatcccaagatgaatcagaggagttttgctcatttttaattggttaccagatgttgctcttgatattctatatttaattactggtaacacaccaatcctcaaatgtatatacttaatgttacttaaatgcttcctcattggtcaagagaatttatttcactgccatttttgattattgtgtttaaactttggcttagtacagtcatcacctttaccttcagatccactggagagaaaacaaaatatcacatttctttccaagacatggatatccttatcatttcgcagtgattacatcagaagttccttctcatatggacattagatgtgcttgttgttttgatttttatttgctttaggtatttctaggcagagttcacaaggcagattataagtttggggggagtcttgaaattataaggagatacatacaataattattgtatagtattagggccattttgccttattaaagtgggaaccatgcttatagactaaaagatccacatatataacaacataaacagaattctcccaagaaactattttaatctaaaatcttttttactactatagataccccaattatcaatagatgaactgaatagcagcatgtttgtttcacagatgtagaagttctcagtagaacagtaagtttctttcagtattaatataaataatatttataggctacatattttatttacacaattgcacttctaaaaggctttcgtaaatattttcattcatagacattgcttgtgatgtagagcttgatttacacattataaattttccaaattgaaatgtgagtgcaaatatgcaatattttttatatggcaatgacagctggtactgtattttctcaatgagctaacacattcttaaatgttttcctattattaaaggaatatataatttgttagccagaggcacagattacttttgagttgtaattctttaaccattttatagcttcattttttttttgaagatcaaacaagaattttcaggatttgactgatatgattatgttaaacacagtaagcactatgcctgtcatgtgacattgtattgaattttgagtgacataatttagtaactgagtcattattttcattccaatcatgtctcttttttaaaatttttgttgttgtgggattttttttttctccttcaccctcaatctcctctttgcctggtgcccatcatggcacacacttttttaagcaatcattcacttaagaacatgtgatttctgaagccacttaagactcctaggtattttaattaattctagggacttactaaaatagtgtaccaactctgaattgcataccttcatcatcgaaagtttgaagttctcacacctggagtgtgtcatttggttgaaggaggcagcagttctgttccctcgtgaactagttccccagaccccagctagcccttctttcctgctgaggacacacgggcttagaacactaagtgttctggacagagcagatagccgactggacattaaataaataggtctcctcaatcataaggaaggattttaaaaggcacctttgagcacatgggataactgaaggagctataaattgtcattgtttccagaggtgtcatttgggatagtggcaacttggaaatagcactaaacatgataatgtaggttttgccaacacttgcccaactttcatgggctgctttacgtcaaggtaaccacaagttgtcaaattaactttccaacagagcatgttagggaagagtgattccttcttgcttgattttgttagaaatgtagagatatttggcagaacataatcacttcaatatgtaataggtgctaaaaattcctctaaagttcaaaaatgtaattttgtacaatacaatacccagatttcacaggtaggctacttctgcatggctctaaaacattcagagaaaaagttgaaagtgtatttaatatttgcatatttcaaaatgttcggtatcaaacatgttttctcagtacatgcctgttgaaaggtggacacatgggtgtatgttcaacaaaaagtagatagataatgccttaaacattggattgcatctctgttaggacagttctccacattagcactcaaagggtatcatagactatcatagatatatggttctttcatgatcattctcaaaagccccatttcaatctgaaattcagattggggatattttggcactgttaacagacagaactggaacaagacccaccacactctcctgactcttccttcaataacctttcaatatttctcactctttctttctttctttttttttccatttcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatt
